(12) United States Patent
Peiris et al.

(10) Patent No.: US 7,547,512 B2
(45) Date of Patent: Jun. 16, 2009

(54) HIGH-THROUGHPUT DIAGNOSTIC ASSAY FOR THE HUMAN VIRUS CAUSING SEVERE ACUTE RESPIRATORY SYNDROME (SARS)

(75) Inventors: Joseph S. M. Peiris, Hong Kong (CN); Kwok Yung Yuen, Hong Kong (CN); Lit Man Poon, Hong Kong (CN); Yi Guan, Hong Kong (CN); Kwok Hung Chan, Hong Kong (CN); John M. Nicholls, Hong Kong (CN); Frederick C. Leung, Hong Kong (CN)

(73) Assignee: The University of Hong Kong, Hong Kong (CN)

( * ) Notice: Subject to any disclaimer, the term of this patent is extended or adjusted under 35 U.S.C. 154(b) by 445 days.

(21) Appl. No.: 10/807,807

(22) Filed: Mar. 24, 2004

(65) Prior Publication Data

US 2005/0181357 A1 Aug. 18, 2005

Related U.S. Application Data

(60) Provisional application No. 60/457,031, filed on Mar. 24, 2003, provisional application No. 60/457,730, filed on Mar. 26, 2003, provisional application No. 60/459,931, filed on Apr. 2, 2003, provisional application No. 60/460,357, filed on Apr. 3, 2003, provisional application No. 60/461,265, filed on Apr. 8, 2003, provisional application No. 60/462,805, filed on Apr. 14, 2003, provisional application No. 60/464,886, filed on Apr. 23, 2003, provisional application No. 60/465,738, filed on Apr. 25, 2003, provisional application No. 60/470,935, filed on May 14, 2003.

(51) Int. Cl.
*C12Q 1/68* (2006.01)
*C12Q 1/00* (2006.01)

(52) U.S. Cl. .................. 435/6; 435/4; 536/23.72; 536/24.32; 536/24.33

(58) Field of Classification Search .................. 435/5, 435/235.1, 91.2; 536/23.72, 24.32, 24.33
See application file for complete search history.

(56) References Cited

U.S. PATENT DOCUMENTS

2004/0265796 A1* 12/2004 Briese et al. .................. 435/5

FOREIGN PATENT DOCUMENTS

WO  WO 02/057302  7/2002

OTHER PUBLICATIONS

Centers for Disease Control and Prevention, "Update: Outbreak of Severe Acute Respiratory Syndrome—Worldwide, 2003," *Morbidity and Mortality Weekly Report*, Apr. 4, 2003, vol. 52, No. 13, pp. 269-296.

Cheung, C. Y. et al., "Induction of proinflammatory cytokines in human macrophages by influenza A (H5N1) viruses: a mechanism for the unusual severity of human disease," *Lancet*, 2002, vol. 360, pp. 1831-1837.

Drosten, C. et al., "Identification of a Novel Coronavirus in Patients with Severe Acute Respiratory Syndrome," *The New England Journal of Medicine*, May 15, 2003, vol. 348, pp. 1967-1976.

Rota et al., "Characterization of a Novel Coronavirus Associated with Severe Acute Respiratory Syndrome," *Science*, 2003, vol. 300, pp. 1394-1399.

Yam, W. C. et al., "Evaluation of Reverse Transcription-PCR Assays for Rapid Diagnosis of Severe Acute Respiratory Syndrome Associated with a Novel Coronavirus," *J. Clin. Microbiol.*, 2003, vol. 41, pp. 4521-4524.

Yuen, K. Y. et al., "Clinical features and rapid viral diagnosis of human disease associated with avian influenza A H5N1 virus," *Lancet*, 1998, vol. 351, pp. 467-471.

* cited by examiner

*Primary Examiner*—Bruce R. Campbell
*Assistant Examiner*—Louise Humphrey
(74) *Attorney, Agent, or Firm*—Saliwanchik, Lloyd & Saliwanchik

(57) ABSTRACT

The present invention relates to a high-throughput diagnostic assay for the virus causing Severe Acute Respiratory Syndrome (SARS) in humans ("hSARS virus"). In particular, the invention relates to a high-throughput reverse transcription-PCR diagnostic test for SARS associated *coronavirus* (SARS-CoV). The present assay is a rapid, reliable assay which can be used for diagnosis and monitoring the spread of SARS and is based on the nucleotide sequences of the N (nucleocapsid)-gene of the hSARS virus. The present method eliminates false negative results and provides increased sensitivity for the assay. The invention also discloses the S (spike)-gene of the hSARS virus. The invention further relates to the deduced amino acid sequences of the N-gene and S-gene products of the hSARS virus and to the use of the N-gene and S-gene products in diagnostic methods. The invention further encompasses diagnostic assays and kits comprising antibodies generated against the N-gene or S-gene product.

5 Claims, 106 Drawing Sheets

Figure 2:
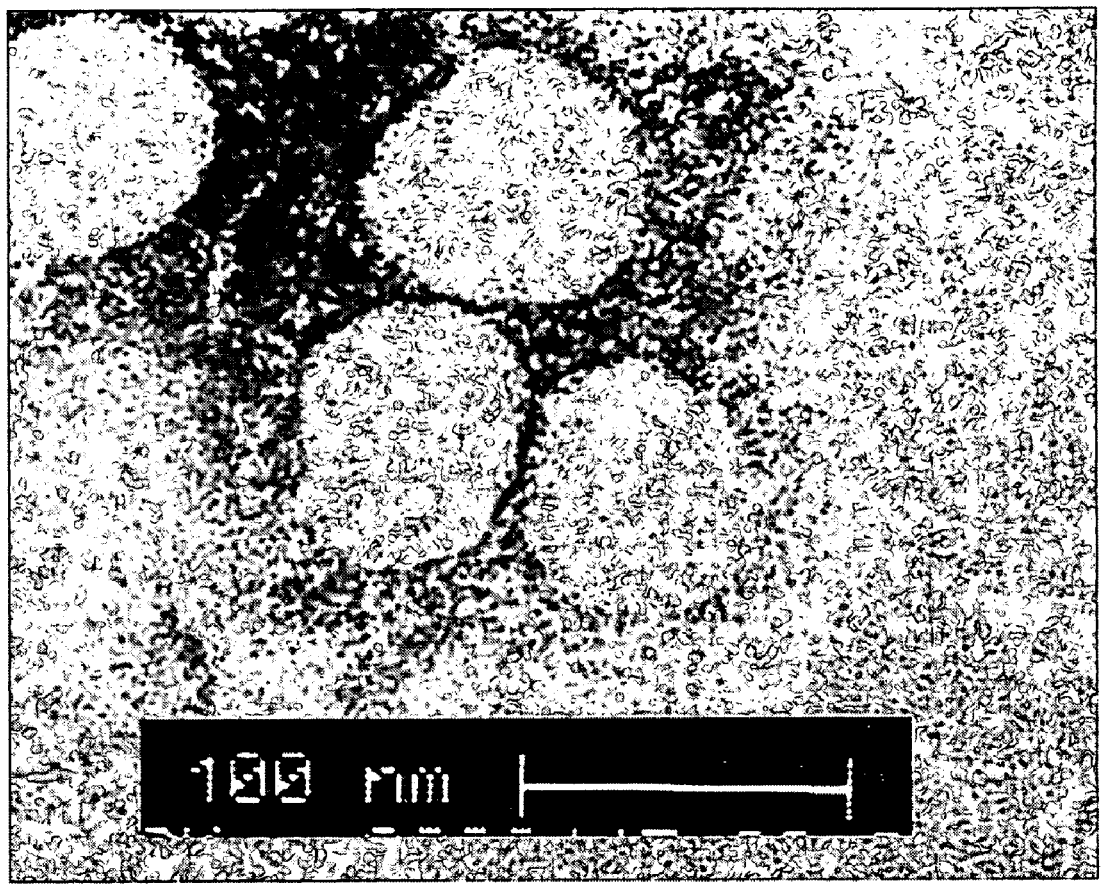

```
a cag gac gct gta gct tca aaa atc tta gga ttg cct acg cag act gtt  49
  Gln Asp Ala Val Ala Ser Lys Ile Leu Gly Leu Pro Thr Gln Thr Val
   1               5                  10                  15
gat tca tca cag ggt tct gaa tat gac tat gtc ata ttc aca caa act    97
Asp Ser Ser Gln Gly Ser Glu Tyr Asp Tyr Val Ile Phe Thr Gln Thr
                20              25                  30
act gaa aca gca cac tct tgt aat gtc aac cgc ttc aat gtg gct atc   145
Thr Glu Thr Ala His Ser Cys Asn Val Asn Arg Phe Asn Val Ala Ile
         35              40                  45
aca agg gca aaa att ggc att ttg tgc ata atg tct gat aga gat ctt   193
Thr Arg Ala Lys Ile Gly Ile Leu Cys Ile Met Ser Asp Arg Asp Leu
         50              55                  60
tat gac aaa ctg caa ttt aca agt cta gaa ata cca cgt cgc aat gtg   241
Tyr Asp Lys Leu Gln Phe Thr Ser Leu Glu Ile Pro Arg Arg Asn Val
 65              70                  75                  80
gct aca tta caa gca gaa aat gta act gga ctt ttt aag gac tgt agt   289
Ala Thr Leu Gln Ala Glu Asn Val Thr Gly Leu Phe Lys Asp Cys Ser
                85                  90                  95
aag atc att act ggt ctt cat cct aca cag gca cct aca cac ctc agc   337
Lys Ile Ile Thr Gly Leu His Pro Thr Gln Ala Pro Thr His Leu Ser
            100                 105                 110
gtt gat ata aaa ttc aag act gaa gga tta tgt gtt gac ata cca ggc   385
Val Asp Ile Lys Phe Lys Thr Glu Gly Leu Cys Val Asp Ile Pro Gly
            115                 120                 125
ata cca aag gac atg acc tac cgt aga ctc atc tct atg atg ggt ttc   433
Ile Pro Lys Asp Met Thr Tyr Arg Arg Leu Ile Ser Met Met Gly Phe
        130                 135                 140
aaa atg aat tac caa gtc aat ggt tac cct aat atg ttt atc acc cgc   481
Lys Met Asn Tyr Gln Val Asn Gly Tyr Pro Asn Met Phe Ile Thr Arg
145                 150                 155                 160
gaa gaa gct att cgt cac gtt cgt gcg tgg att ggc ttt gat gta gag   529
Glu Glu Ala Ile Arg His Val Arg Ala Trp Ile Gly Phe Asp Val Glu
                165                 170                 175
ggc tgt cat gca act aga gat gct gtg ggt act aac cta cct ctc cag   577
Gly Cys His Ala Thr Arg Asp Ala Val Gly Thr Asn Leu Pro Leu Gln
            180                 185                 190
cta gga ttt tct aca ggt gtt aac tta gta gct gta ccg act ggt tat   625
Leu Gly Phe Ser Thr Gly Val Asn Leu Val Ala Val Pro Thr Gly Tyr
        195                 200                 205
gtt gac act gaa aat aac cta                                       646
Val Asp Thr Glu Asn Asn Leu
    210                 215
```

FIG. 1

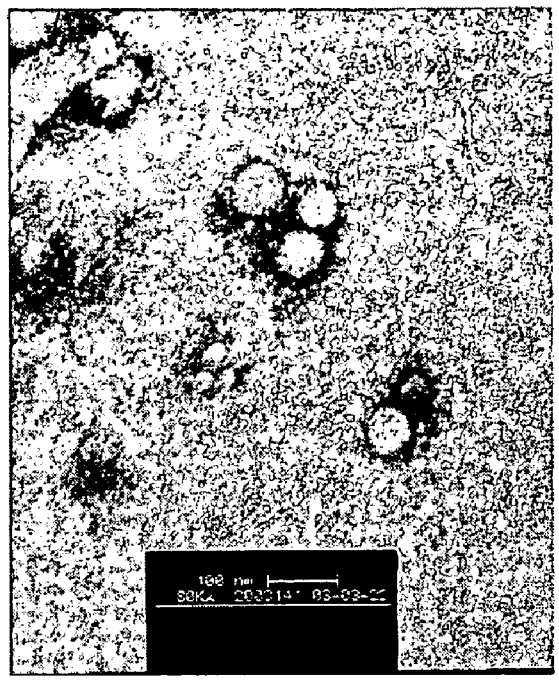
FIG. 4
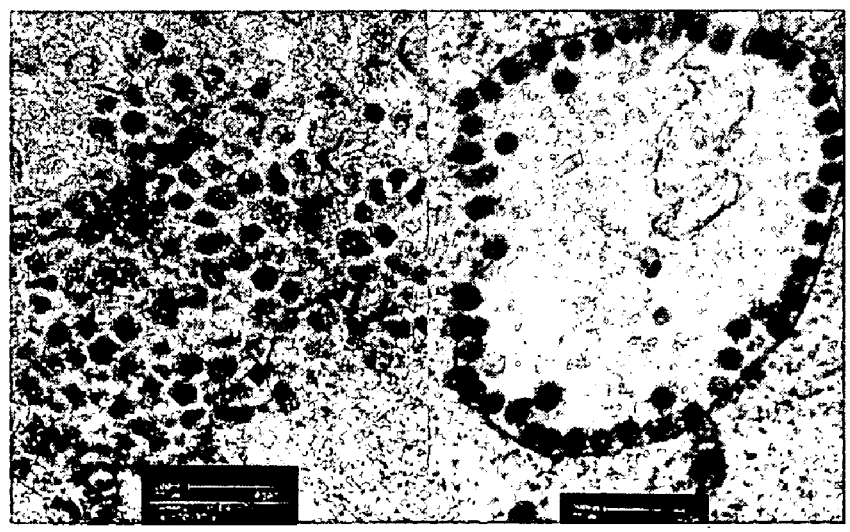
FIG. 5A  FIG. 5B

```
t aaa tgt agt aga atc ata cct gcg cgt gcg cgc gta gag tgt ttt gat    49
  Lys Cys Ser Arg Ile Ile Pro Ala Arg Ala Arg Val Glu Cys Phe Asp
   1               5                  10                  15 aaa ttc aaa gtg aat tca aca cta gaa cag tat gtt ttc tgc act gta      97
Lys Phe Lys Val Asn Ser Thr Leu Glu Gln Tyr Val Phe Cys Thr Val
             20                  25                  30 aat gca ttg cca gaa aca act gct gac att gta gtc ttt gat gaa atc     145
Asn Ala Leu Pro Glu Thr Thr Ala Asp Ile Val Val Phe Asp Glu Ile
             35                  40                  45 tct atg gct act aat tat gac ttg agt gtt gtc aat gca aga ctt cgt    193
Ser Met Ala Thr Asn Tyr Asp Leu Ser Val Val Asn Ala Arg Leu Arg
         50                  55                  60 gca aaa cac tac gtc tat att ggc gat cct gct caa tta cca gcc ccc    241
Ala Lys His Tyr Val Tyr Ile Gly Asp Pro Ala Gln Leu Pro Ala Pro
65                  70                  75                  80 cgc aca ttg ctg act aaa ggc aca cta gaa cca gaa tat ttt aat tca    289
Arg Thr Leu Leu Thr Lys Gly Thr Leu Glu Pro Glu Tyr Phe Asn Ser
                 85                  90                  95 gtg tgc aga ctt atg aaa aca ata ggt cca gac atg ttc ctt gga act    337
Val Cys Arg Leu Met Lys Thr Ile Gly Pro Asp Met Phe Leu Gly Thr
            100                 105                 110 tgt cgc cgt tgt cct gct gaa att gtt gac act gtg agt gct tta gtt    385
Cys Arg Arg Cys Pro Ala Glu Ile Val Asp Thr Val Ser Ala Leu Val
            115                 120                 125 tat gac aat aag cta aaa gca cac aag gag aag tca gct caa tgc ttc    433
Tyr Asp Asn Lys Leu Lys Ala His Lys Glu Lys Ser Ala Gln Cys Phe
        130                 135                 140 aaa atg ttc tac aaa ggt gtt att aca cat gat gtt tca tct gca atc    481
Lys Met Phe Tyr Lys Gly Val Ile Thr His Asp Val Ser Ser Ala Ile
145                 150                 155                 160 aac aga cct caa ata ggc gtt gta aga gaa ttt ctt aca cgc aat cct    529
Asn Arg Pro Gln Ile Gly Val Val Arg Glu Phe Leu Thr Arg Asn Pro
                165                 170                 175 gct tgg aga aaa gct gtt ttt atc tca cct tat aat tca cag aac gct    577
Ala Trp Arg Lys Ala Val Phe Ile Ser Pro Tyr Asn Ser Gln Asn Ala
            180                 185                 190 gta gct tca aaa atc tta gga ttg cct acg cag act gtt gat tca tca    625
Val Ala Ser Lys Ile Leu Gly Leu Pro Thr Gln Thr Val Asp Ser Ser
            195                 200                 205 cag ggt tct gaa tat gac tat gtc ata ttc aca caa act act gaa aca    673
Gln Gly Ser Glu Tyr Asp Tyr Val Ile Phe Thr Gln Thr Thr Glu Thr
        210                 215                 220
```

FIG. 8

```
gca cac tct tgt aat gtc aac cgc ttc aat gtg gct atc aca agg gca    721
Ala His Ser Cys Asn Val Asn Arg Phe Asn Val Ala Ile Thr Arg Ala
225             230                 235                 240 aaa att ggc att ttg tgc ata atg tct gat aga gat ctt tat gac aaa    769
Lys Ile Gly Ile Leu Cys Ile Met Ser Asp Arg Asp Leu Tyr Asp Lys
                245                 250                 255 ctg caa ttt aca agt cta gaa ata cca cgt cgc aat gtg gct aca tta    817
Leu Gln Phe Thr Ser Leu Glu Ile Pro Arg Arg Asn Val Ala Thr Leu
        260                 265                 270 caa gca gaa aat gta act gga ctt ttt aag gac tgt agt aag atc att    865
Gln Ala Glu Asn Val Thr Gly Leu Phe Lys Asp Cys Ser Lys Ile Ile
        275                 280                 285 act ggt ctt cat cct aca cag gca cct aca cac ctc agc gtt gat ata    913
Thr Gly Leu His Pro Thr Gln Ala Pro Thr His Leu Ser Val Asp Ile
    290                 295                 300 aaa ttc aag act gaa gga tta tgt gtt gac ata cca ggc ata cca aag    961
Lys Phe Lys Thr Glu Gly Leu Cys Val Asp Ile Pro Gly Ile Pro Lys
305                 310                 315                 320 gac atg acc tac cgt aga ctc atc tct atg atg ggt ttc aaa atg aat   1009
Asp Met Thr Tyr Arg Arg Leu Ile Ser Met Met Gly Phe Lys Met Asn
                325                 330                 335 tac caa gtc aat ggt tac cct aat atg ttt atc acc cgc gaa gaa gct   1057
Tyr Gln Val Asn Gly Tyr Pro Asn Met Phe Ile Thr Arg Glu Glu Ala
            340                 345                 350 att cgt cac gtt cgt gcg tgg att ggc ttt gat gta gag ggc tgt cat   1105
Ile Arg His Val Arg Ala Trp Ile Gly Phe Asp Val Glu Gly Cys His
        355                 360                 365 gca act aga gat gct gtg ggt act aac cta cct ctc cag cta gga ttt   1153
Ala Thr Arg Asp Ala Val Gly Thr Asn Leu Pro Leu Gln Leu Gly Phe
    370                 375                 380 tct aca ggt gtt aac tta gta gct gta ccg act ggt tat gtt gac act   1201
Ser Thr Gly Val Asn Leu Val Ala Val Pro Thr Gly Tyr Val Asp Thr
385                 390                 395                 400 gaa aat aac cta                                                   1213
Glu Asn Asn Leu
```

FIG. 8 Con't

```
  c aga acc atg cct aac atg ctt agg ata atg gcc tct ctt gtt ctt gct    49
    Arg Thr Met Pro Asn Met Leu Arg Ile Met Ala Ser Leu Val Leu Ala
     1           5                  10                  15 cgc aaa cat aac act tgc tgt aac tta tca cac cgt ttc tac agg tta    97
    Arg Lys His Asn Thr Cys Cys Asn Leu Ser His Arg Phe Tyr Arg Leu
                    20                  25                  30 gct aac gag tgt gcg caa gta tta agt gag atg gtc atg tgt ggc ggc   145
    Ala Asn Glu Cys Ala Gln Val Leu Ser Glu Met Val Met Cys Gly Gly
                35                  40                  45 tca cta tat gtt aaa cca ggt gga aca tca tcc ggt gat gct aca act   193
    Ser Leu Tyr Val Lys Pro Gly Gly Thr Ser Ser Gly Asp Ala Thr Thr
         50                  55                  60 gct tat gct aat agt gtc ttt aac att tgt caa gct gtt aca gcc aat   241
    Ala Tyr Ala Asn Ser Val Phe Asn Ile Cys Gln Ala Val Thr Ala Asn
    65                  70                  75                  80 gta aat gca ctt ctt tca act gat ggt aat aag ata gct gac aag tat   289
    Val Asn Ala Leu Leu Ser Thr Asp Gly Asn Lys Ile Ala Asp Lys Tyr
                    85                  90                  95 gtc cgc aat cta caa cac agg ctc tat gag tgt ctc tat aga aat agg   337
    Val Arg Asn Leu Gln His Arg Leu Tyr Glu Cys Leu Tyr Arg Asn Arg
                100                 105                 110 gat gtt gat cat gaa ttc gtg gat gag ttt tac gct tac ctg cgt aaa   385
    Asp Val Asp His Glu Phe Val Asp Glu Phe Tyr Ala Tyr Leu Arg Lys
                115                 120                 125 cat ttc tcc atg atg att ctt tct gat gat gcc gtt gtg tgc tat aac   433
    His Phe Ser Met Met Ile Leu Ser Asp Asp Ala Val Val Cys Tyr Asn
            130                 135                 140 agt aac tat gcg gct caa ggt tta gta gct agc att aag aac ttt aag   481
    Ser Asn Tyr Ala Ala Gln Gly Leu Val Ala Ser Ile Lys Asn Phe Lys
    145                 150                 155                 160 gca gtt ctt tat tat caa aat aat gtg ttc atg tct gag gca aaa tgt   529
    Ala Val Leu Tyr Tyr Gln Asn Asn Val Phe Met Ser Glu Ala Lys Cys
                    165                 170       S         175 tgg act gag act gac ctt act aaa gga cct cac gaa ttt tgc tca cag   577
    Trp Thr Glu Thr Asp Leu Thr Lys Gly Pro His Glu Phe Cys Ser Gln
                180                 185                 190 cat aca atg cta gtt aaa caa gga gat gat tac gtg tac ctg cct tac   625
    His Thr Met Leu Val Lys Gln Gly Asp Asp Tyr Val Tyr Leu Pro Tyr
            195                 200                 205 cca gat cca tca aga ata tta ggc gca ggc tgt ttt gtc gat gat att   673
    Pro Asp Pro Ser Arg Ile Leu Gly Ala Gly Cys Phe Val Asp Asp Ile
        210                 215                 220 gtc aaa cag atg gta cac tta tga ttg aaa ggt tcc gtg tca ctg gct   721
    Val Lys Gln Met Val His Leu
    225                 230 att gat gc                                                         729
```

FIG. 9

```
   1 atattaggtt tttacctacc caggaaaagc caaccaacct cgatctcttg tagatctgtt
  61 ctctaaacga actttaaaat ctgtgtagct gtcgctcggc tgcatgccta gtgcacctac
 121 gcagtataaa caataataaa ttttactgtc gttgacaaga aacgagtaac tcgtccctct
 181 tctgcagact gcttacggtt tcgtccgtgt tgcagtcgat catcagcata cctaggtttc
 241 gtccgggtgt gaccgaaagg taagatggag agccttgttc ttggtgtcaa cgagaaaaca
 301 cacgtccaac tcagtttgcc tgtccttcag gttagagacg tgctagtgcg tggcttcggg
 361 gactctgtgg aagaggccct atcggaggca cgtgaacacc tcaaaaatgg cacttgtggt
 421 ctagtagagc tggaaaaagg cgtactgccc cagcttgaac agccctatgt gttcattaaa
 481 cgttctgatg ccttaagcac caatcacggc cacaaggtcg ttgagctggt tgcagaaatg
 541 gacggcattc agtacggtcg tagcggtata cactgggag tactcgtgcc acatgtgggc
 601 gaaacccccaa ttgcataccg caatgttctt cttcgtaaga acggtaataa gggagccggt
 661 ggtcatagct atggcatcga tctaaagtct tatgacttag gtgacgagct tggcactgat
 721 cccattgaag attatgaaca aaactggaac actaagcatg gcagtggtgc actccgtgaa
 781 ctcactcgtg agctcaatgg aggtgcagtc actcgctatg tcgacaacaa tttctgtggc
 841 ccagatgggt accctcttga ttgcatcaaa gattttctcg cacgcgcggg caagtcaatg
 901 tgcactcttt ccgaacaact tgattacatc gagtcgaaga gaggtgtcta ctgctgccgt
 961 gaccatgagc atgaaattgc ctggttcact gagcgctctg ataagagcta cgagcaccag
1021 acacccttcg aaattaagag tgccaagaaa tttgacactt caaaggggga atgcccaaag
1081 tttgtgtttc ctcttaactc aaaagtcaaa gtcattcaac cacgtgttga aaagaaaaag
1141 actgagggtt tcatggggcg tatacgctct gtgtaccctg ttgcatctcc acaggagtgt
1201 aacaatatgc acttgtctac cttgatgaaa tgtaatcatt gcgatgaagt tcatggcag
1261 acgtgcgact ttctgaaagc cacttgtgaa cattgtggca ctgaaaattt agttattgaa
1321 ggacctacta catgtgggta cctacctact aatgctgtag tgaaaatgcc atgtcctgcc
1381 tgtcaagacc cagagattgg acctgagcat agtgttgcag attatcacaa ccactcaaac
1441 attgaaactc gactccgcaa gggaggtagg actagatgtt ttggaggctg tgtgtttgcc
1501 tatgttggct gctataataa gcgtgcctac tgggttcctc gtgctagtgc tgatattggc
1561 tcaggccata ctggcattac tggtgacaat gtggagacct gaatgagga tctccttgag
1621 atactgagtc gtgaacgtgt taacattaac attgttggcg attttcattt gaatgaagag
1681 gttgccatca ttttggcatc tttctctgct tctacaagtg cctttattga cactataaag
1741 agtcttgatt acaagtcttt caaaaccatt gttgagtcct gcggtaacta taaagttacc
1801 aagggaaagc ccgtaaaagg tgcttggaac attggacaac agagatcagt tttaacacca
1861 ctgtgtggtt ttccctcaca ggctgctggt gttatcagat caattttgc gcgcacactt
1921 gatgcagcaa accactcaat tcctgatttg caaagagcag ctgtcaccat acttgatggt
1981 atttctgaac agtcattacg tcttgtcgac gccatggttt atacttcaga cctgctcacc
2041 aacagtgtca ttattatggc atatgtaact ggtggtcttg tacaacagac ttctcagtgg
2101 ttgtctaatc ttttgggcac tactgttgaa aaactcaggc ctatctttga atggattgag
2161 gcgaaactta gtgcaggagt tgaatttctc aaggatgctt gggagattct caaatttctc
2221 attacaggtg tttttgacat cgtcaagggt caaatacagg ttgcttcaga taacatcaag
2281 gattgtgtaa aatgcttcat tgatgttgtt aacaaggcac tcgaaatgtg cattgatcaa
2341 gtcactatcg ctggcgcaaa gttgcgatca ctcaacttag gtgaagtctt catcgctcaa
2401 agcaagggac tttaccgtca gtgtatacgt ggcaaggagc agctgcaact actcatgcct
2461 cttaaggcac caaaagaagt aacctttctt gaaggtgatt cacatgacac agtacttacc
2521 tctgaggagg ttgttctcaa gaacggtgaa ctcgaagcac tcgagacgcc cgttgatagc
2581 ttcacaaatg gagctatcgt cggcacacca gtctgtgtaa atggcctcat gctcttagag
2641 attaaggaca agaacaata ctgcgcattg tctcctggtt tactggctac aaacaatgtc
2701 tttcgcttaa aaggggggtgc accaattaaa ggtgtaacct tggagaaga tactgtttgg
2761 gaagttcaag gttacaagaa tgtgagaatc acatttgagc ttgatgaacg tgttgacaaa
2821 gtgcttaatg aaaagtgctc tgtctacact gttgaatccg gtaccgaagt tactgagttt
2881 gcatgtgttg tagcagaggc tgttgtgaag acttacaac cagtttctga tctccttacc
2941 aacatgggta ttgatcttga tgagtggagt gtagctacat ctacttatt tgatgatgct
3001 ggtgaagaaa acttttcatc acgtatgtat tgttcctttt accctccaga tgaggaagaa
3061 gaggacgatg cagagtgtga ggaagaagaa attgatgaaa cctgtgaaca tgagtacggt
3121 acagaggatg attatcaagg tctccctctg gaatttggtg cctcagctga aacagttcga
3181 gttgaggaag aagaagagga agactggctg gatgatacta ctgagcaatc agagattgag
3241 ccagaaccag aacctacacc tgaagaacca gttaatcagt ttactggtta tttaaaactt
3301 actgacaatg ttgccattaa atgtgttgac atcgttaagg aggcacaaag tgctaatcct
```

```
3361 atggtgattg taaatgctgc taacatacac ctgaaacatg gtggtggtgt agcaggtgca
3421 ctcaacaagg caaccaatgg tgccatgcaa aaggagagtg atgattacat taagctaaat
3481 ggccctctta cagtaggagg gtcttgtttg ctttctggac ataatcttgc taagaagtgt
3541 ctgcatgttg ttggacctaa cctaaatgca ggtgaggaca tccagcttct taaggcagca
3601 tatgaaaatt tcaattcaca ggacatctta cttgcaccat tgttgtcagc aggcatattt
3661 ggtgctaaac cacttcagtc tttacaagtg tgcgtgcaga cggttcgtac acaggtttat
3721 attgcagtca atgacaaagc tctttatgag caggttgtca tggattatct tgataacctg
3781 aagcctagag tggaagcacc taaacaagag gagccaccaa acacagaaga ttccaaaact
3841 gaggagaaat ctgtcgtaca gaagcctgtc gatgtgaagc caaaaattaa ggcctgcatt
3901 gatgaggtta ccacaacact ggaagaaact aagtttctta ccaataagtt actcttgttt
3961 gctgatatca tggtaagctt taccatgat tctcagaaca tgcttagagg tgaagatatg
4021 tctttccttg agaaggatgc accttacatg gtaggtgatg ttatcactag tggtgatatc
4081 acttgtgttg taatacoctc caaaaaggct ggtggcacta ctgagatgct ctcaagagct
4141 ttgaagaaag tgccagttga tgagtatata accacgtacc ctggacaagg atgtgctggt
4201 tatacacttg aggaagctaa gactgctctt aagaaatgca aatctgcatt ttatgtacta
4261 ccttcagaag cacctaatgc taaggaagag attctaggaa ctgtatcctg gaatttgaga
4321 gaaatgcttg ctcatgctga agagacaaga aaattaatgc ctatatgcat ggatgttaga
4381 gccataatgg caaccatcca acgtaagtat aaaggaatta aaattcaaga gggcatcgtt
4441 gactatggtg tccgattctt cttttatact agtaaagagc ctgtagcttc tattattacg
4501 aagctgaact ctctaaatga ccgcttgtc acaatgccaa ttggttatgt gacacatggt
4561 tttaatcttg aagaggctgc gcgctgtatg cgttctctta agctcctgc cgtagtgtca
4621 gtatcatcac cagatgctgt tactacatat aatggatacc tcacttcgtc atcaaagaca
4681 tctgaggagc actttgtaga aacagttct ttggctggct cttacagaga ttggtcctat
4741 tcaggacagc gtacagagtt aggtgttgaa tttcttaagc gtggtgacaa aattgtgtac
4801 cacactctgg agagcccgt cgagtttcat cttgacggtg aggttctttc acttgacaaa
4861 ctaaagagtc tcttatccct gcgggaggtt aagactataa aagtgttcac aactgtggac
4921 aacactaatc tccacacaca gcttgtggat atgtctatga catatggaca gcagtttggt
4981 ccaacatact ggatggtgc tgatgttaca aaaattaaac ctcatgtaaa tcatgagggt
5041 aagactttct ttgtactacc tagtgatgac acactacgta gtgaagcttt cgagtactac
5101 catactcttg atgagagttt tcttggtagg tacatgtctg ctttaaacca cacaaagaaa
5161 tggaaatttc ctcaagttgg tggtttaact tcaattaaat gggctgataa caattgttat
5221 ttgtctagtg ttttattagc acttcaacag cttgaagtca aattcaatgc accagcactt
5281 caagaggctt attatagagc ccgtgctggt gatgctgcta acttttgtgc actcatactc
5341 gcttacagta ataaaactgt tggcgagctt ggtgatgtca gagaaactat gacccatctt
5401 ctacagcatg ctaatttgga atctgcaaag cgagttctta atgtggtgtg taaacattgt
5461 ggtcagaaaa ctactacctt aacgggtgta gaagctgtga tgtatatggg tactctatct
5521 tatgataatc ttaagacagg tgtttccatt ccatgtgtgt gtggtcgtga tgctacacaa
5581 tatctagtac aacaagagtc ttctttgtt atgatgtctg caccacctgc tgagtataaa
5641 ttacagcaag gtacattctt atgtgcgaat gagtacactg gtaactatca gtgtggtcat
5701 tacactcata taactgctaa ggagaccctc tatcgtattg acggagctca ccttacaaag
5761 atgtcagagt acaaaggacc agtgactgat gttttctaca aggaaacatc ttacactaca
5821 accatcaagc ctgtgtcgta taaactcgat ggagttactt acacagagat tgaaccaaaa
5881 ttggatgggt attataaaaa ggataatgct tactatacag agcagcctat agaccttgta
5941 ccaactcaac cattaccaaa tgcgagtttt gataatttca actcacatg ttctaacaca
6001 aaatttgctg atgatttaaa tcaaatgaca ggcttcacaa agccagcttc acgagagcta
6061 tctgtcacat tcttcccaga cttgaatggc gatgtagtgg ctattgacta tagacactat
6121 tcagcgagtt tcaagaaagg tgctaaatta ctgcataagc caattgtttg gcacattaac
6181 caggctacaa ccaagacaac gttcaaacca acacttggt gtttacgttg tctttggagt
6241 acaaagccag tagatacttc aaattcattt gaagttctgg cagtagaaga cacacaagga
6301 atggacaatc ttgcttgtga agtcaacaa cccacctctg aagaagtagt ggaaaatcct
6361 accatacaga aggaagtcat agagtgtgac gtgaaaacta ccgaagttgt aggcaatgtc
6421 atacttaaac catcagatga aggtgttaaa gtaacacaag agttaggtca tgaggatctt
6481 atggctgctt atgtggaaaa cacaagcatt accattaaga aacctaatga gctttcacta
6541 gccttaggtt taaaaacaat tgccactcat ggtattgctg caattaatag tgttccttgg
6601 agtaaaattt tggcttatgt caaaccattc ttaggacaag cagcaattac aacatcaaat
6661 tgcgctaaga gattagcaca acgtgtgttt aacaattata tgccttatgt gtttacatta
```

FIG. 10 Con't

```
6721 ttgttccaat tgtgtacttt tactaaaagt accaattcta gaattagagc ttcactacct
6781 acaactattg ctaaaaatag tgttaagagt gttgctaaat tatgtttgga tgccggcatt
6841 aattatgtga agtcacccaa attttctaaa ttgttcacaa tcgctatgtg gctattgttg
6901 ttaagtattt gcttaggttc tctaatctgt gtaactgctg cttttggtgt actcttatct
6961 aattttggtg ctccttctta ttgtaatggc gttagagaat tgtatcttaa ttcgtctaac
7021 gttactacta tggatttctg tgaaggttct tttccttgca gcatttgttt aagtggatta
7081 gactcccttg attcttatcc agctcttgaa accattcagg tgacgatttc atcgtacaag
7141 ctagacttga caatttttagg tctggccgct gagtgggttt tggcatatat gttgttcaca
7201 aaattctttt atttattagg tctttcagct ataatgcagg tgttctttgg ctattttgct
7261 agtcatttca tcagcaattc ttggctcatg tggtttatca ttagtattgt acaaatggca
7321 cccgtttctg caatggttag gatgtacatc ttctttgctt ctttctacta catatggaag
7381 agctatgttc atatcatgga tggttgcacc tcttcgactt gcatgatgtg ctataagcgc
7441 aatcgtgcca cacgcgttga gtgtacaact attgttaatg gcatgaagag atctttctat
7501 gtctatgcaa atggaggccg tggcttctgc aagactcaca attggaattg tctcaattgt
7561 gacacatttt gcactggtag tacattcatt agtgatgaag ttgctcgtga tttgtcactc
7621 cagtttaaaa gaccaatcaa ccctactgac cagtcatcgt atattgttga tagtgttgct
7681 gtgaaaaatg cgcgcttca cctctacttt gacaaggctg gtcaaaagac ctatgagaga
7741 catccgctct cccatttgt caatttagac aatttgagag ctaacaacac taaaggttca
7801 ctgcctatta atgtcatagt ttttgatggc aagtccaaat gcgacgagtc tgcttctaag
7861 tctgcttctg tgtactacag tcagctgatg tgccaaccta ttctgttgct tgaccaagct
7921 cttgtatcaa acgttggaga tagtactgaa gtttccgtta agatgtttga tgcttatgtc
7981 gacacctttt cagcaacttt tagtgttcct atggaaaaac ttaaggcact tgttgctaca
8041 gctcacagcg agttagcaaa gggtgtagct ttagatggtg tccttctac attcgtgtca
8101 gctgcccgac aaggtgttgt tgataccgat gttgacacaa aggatgttat tgaatgtctc
8161 aaactttcac atcactctga cttagaagtg acaggtgaca gttgtaacaa tttcatgctc
8221 acctataata aggttgaaaa catgacgccc agagatcttg gcgcatgtat tgactgtaat
8281 gcaaggcata tcaatgccca agtagcaaaa agtcacaatg tttcactcat ctggaatgta
8341 aaagactaca tgtctttatc tgaacagctg cgtaaacaaa ttcgtactgc tgccaagaag
8401 acaacatac cttttacact aacttgtgct acaactagac aggttgtcaa tgtcataact
8461 actaaaatct cactcaaggg tggtaagatt gttagtactt gttttaaact tatgcttaag
8521 gccacattat tgtgcgttct tgctgcattg gtttgttata tcgttatgcc agtacataca
8581 ttgtcaatcc atgatggtta cacaaatgaa atcattggtt acaaagccat tcaggatggt
8641 gtcactcgtg acatcatttc tactgatgat tgttttgcaa ataaacatgc tggttttgac
8701 gcatggttta gccagcgtgg tggttcatac aaaaatgaca aaagctgccc tgtagtagct
8761 gctatcatta caagagagat tggtttcata gtgcctggct taccgggtac tgtgctgaga
8821 gcaatcaatg gtgacttctt gcatttccta cctcgtgttt ttagtgctgt tggcaacatt
8881 tgctacacac cttccaaact cattgagtat agtgattttg ctacctctgc ttgcgttctt
8941 gctgctgagt gtacaatttt taaggatgct atgggcaaac tgtgccata ttgttatgac
9001 actaatttgc tagagggttc tatttcttat agtgagcttc gtccagacac tcgttatgtg
9061 cttatggatg gttccatcat acagtttcct aacacttacc tggagggttc tgttagagta
9121 gtaacaactt ttgatgctga gtactgtaga catggtacat gcgaaaggtc agaagtaggt
9181 atttgcctat ctaccagtgg tagatgggtt cttaataatg agcattacag agctctatca
9241 ggagttttct gtggtgttga tgcgatgaat ctcatagcta acatctttac tcctcttgtg
9301 caacctgtgg gtgctttaga tgtgtctgct tcagtagtgg ctggtggtat tattgccata
9361 ttggtgactt gtgctgccta ctactttatg aaattcagac gtgttttttgg tgagtacaac
9421 catgttgttg ctgctaatgc acttttgttt ttgatgtctt tcactatact ctgtctggta
9481 ccagcttaca gctttctgcc gggagtctac tcagtctttt acttgtactt gacattctat
9541 ttcaccaatg atgtttcatt cttggctcac cttcaatggt ttgccatgtt ttctcctatt
9601 gtgccttttt ggataacagc aatctatgta ttctgtattt ctctgaagca ctgccattgg
9661 ttctttaaca actatcttag gaaagagtc atgtttaatg gagttacatt tagtaccttc
9721 gaggaggctg ctttgtgtac cttttgctc aacaaggaaa tgtacctaaa attgcgtagc
9781 gagacactgt tgccacttac acagtataac aggtatcttg ctctatataa caagtacaag
9841 tatttcagtg gagccttaga tactaccagc tatcgtgaag cagcttgctg ccacttagca
9901 aaggctctaa atgactttag caactcaggt gctgatgttc tctaccaacc accacagaca
9961 tcaatcactt ctgctgttct gcagagtggt tttaggaaaa tggcattccc gtcaggcaaa
10021 gttgaagggt gcatggtaca agtaacctgt ggaactacaa ctcttaatgg attgtggttg
```

FIG. 10 Con't

```
10081 gatgacacag tatactgtcc aagacatgtc atttgcacag cagaagacat gcttaatcct
10141 aactatgaag atctgctcat tcgcaaatcc aaccatagct ttcttgttca ggctggcaat
10201 gttcaacttc gtgttattgg ccattctatg caaaattgtc tgcttaggct taaagttgat
10261 acttctaacc ctaagacacc caagtataaa tttgtccgta tccaacctgg tcaaacattt
10321 tcagttctag catgctacaa tggttcacca tctggtgttt atcagtgtgc catgagacct
10381 aatcatacca ttaaaggttc tttccttaat ggatcatgtg gtagtgttgg ttttaacatt
10441 gattatgatt gcgtgtcttt ctgctatatg catcatatgg agcttccaac aggagtacac
10501 gctggtactg acttagaagg taaattctat ggtccatttg ttgacagaca aactgcacag
10561 gctgcaggta cagacacaac cataacatta aatgttttgg catggctgta tgctgctgtt
10621 atcaatggtg ataggtggtt tcttaataga ttcaccacta ctttgaatga ctttaacctt
10681 gtggcaatga agtacaacta tgaacctttg acacaagatc atgttgacat attgggacct
10741 ctttctgctc aaacaggaat tgccgtctta gatatgtgtg ctgctttgaa agagctgctg
10801 cagaatggta tgaatggtcg tactatcctt ggtagcacta ttttagaaga tgagtttaca
10861 ccatttgatg ttgttagaca atgctctggt gttaccttcc aaggtaagtt caagaaaatt
10921 gttaagggca ctcatcattg gatgctttta actttcttga catcactatt gattcttgtt
10981 caaagtacac agtggtcact gttttctttt gtttacgaga atgctttctt gccatttact
11041 cttggtatta tggcaattgc tgcatgtgct atgctgcttg ttaagcataa gcacgcattc
11101 ttgtgcttgt ttctgttacc ttctcttgca acagttgctt actttaatat ggtctacatg
11161 cctgctagct gggtgatgcg tatcatgaca tggcttgaat tggctgacac tagcttgtct
11221 ggttataggc ttaaggattg tgttatgtat gcttcagctt tagttttgct tattctcatg
11281 acagctcgca ctgtttatga tgatgctgct agacgtgttt ggacactgat gaatgtcatt
11341 acacttgttt acaaagtcta ctatggtaat gctttagatc aagctatttc catgtgggcc
11401 ttagttattt ctgtaacctc taactattct ggtgtcgtta cgactatcat gtttttagct
11461 agagctatag tgtttgtgtg tgttgagtat tacccattgt tatttattac tggcaacacc
11521 ttacagtgta tcatgcttgt ttattgtttc ttaggctatt gttgctgctg ctactttggc
11581 cttttctgtt tactcaaccg ttacttcagg cttactcttg gtgtttatga ctacttggtc
11641 tctacacaag aatttaggta tatgaactcc caggggcttt gcctcctaa gagtagtatt
11701 gatgctttca agcttaacat taagttgttg ggtattggag gtaaaccatg tatcaaggtt
11761 gctactgtac agtctaaaat gtctgacgta aagtgcacat ctgtggtact gctctcggtt
11821 cttcaacaac ttagagtaga gtcatcttct aaattgtggg cacaatgtgt acaactccac
11881 aatgatattc ttcttgcaaa agacacaact gaagctttcg agaagatggt ttctcttttg
11941 tctgttttgc tatccatgca gggtgctgta gacattaata ggttgtgcga ggaaatgctc
12001 gataaccgtg ctactcttca ggctattgct tcagaattta gttctttacc atcatatgcc
12061 gcttatgcca ctgcccagga ggcctatgag caggctgtag ctaatggtga ttctgaagtc
12121 gttctcaaaa agttaaagaa atctttgaat gtggctaaat ctgagtttga ccgtgatgct
12181 gccatgcaac gcaagttgga aaagatggca gatcaggcta tgacccaaat gtacaaacag
12241 gcaagatctg aggacaagag ggcaaaagta actagtgcta tgcaaacaat gctcttcact
12301 atgcttagga agcttgataa tgatgcactt aacaacatta tcaacaatgc gcgtgatggt
12361 tgtgttccac tcaacatcat accattgact acagcagcca aactcatggt tgttgtccct
12421 gattatggta cctacaagaa cacttgtgat ggtaacacct ttacatatgc atctgcactc
12481 tgggaaatcc agcaagttgt tgatgcggat agcaagattg ttcaacttag tgaaattaac
12541 atggacaatt caccaaattt ggcttggcct cttattgtta cagctctaag agccaactca
12601 gctgttaaac tacagaataa tgaactgagt ccagtagcac tacgacagat gtcctgtgcg
12661 gctggtacca cacaaacagc ttgtactgat gacaatgcac ttgcctacta taacaattcg
12721 aagggagtta ggtttgtgct ggcattacta tcagaccacc aagatctcaa atgggctaga
12781 ttccctaaga gtgatggtac aggtacaatt tacacagaac tggaaccacc ttgtaggttt
12841 gttacagaca caccaaaagg gcctaaagtg aaatacttgt acttcatcaa aggcttaaac
12901 aacctaaata gaggtatggt gctgggcagt ttagctgcta cagtacgtct tcaggctgga
12961 aatgctacag aagtacctgc caattcaact gtgctttcct tctgtgcttt tgcagtagac
13021 cctgctaaag catataagga ttacctagca agtggaggac aaccaatcac caactgtgtg
13081 aagatgttgt gtacacacac tggtacagga caggcaatta ctgtaacacc agaagctaac
13141 atggaccaag agtcctttgg tggtgcttca tgttgtctgt attgtagatg ccacattgac
13201 catccaaatc ctaaaggatt ctgtgacttg aaaggtaagt acgtccaaat acctaccact
13261 tgtgctaatg acccagtggg ttttacactt agaaacacag tctgtaccgt ctgcggaatg
13321 tggaaaggtt atggctgtag ttgtgaccaa ctccgcgaac ccttgatgca gtctgcggat
13381 gcatcaacgt ttttaaacgg gtttgcggtg taagtgcagc ccgtcttaca ccgtgcggca
```

FIG. 10 Con't

```
13441  caggcactag tactgatgtc gtctacaggg cttttgatat ttacaacgaa aaaagtgctg
13501  gttttgcaaa gttcctaaaa actaattgct gtcgcttcca ggagaaggat gaggaaggca
13561  atttattaga ctcttacttt gtagttaaga ggcatactat gtctaactac caacatgaag
13621  agactattta taacttggtt aaagattgtc cagcggttgc tgtccatgac ttttcaagt
13681  ttagagtaga tggtgacatg gtaccacata tatcacgtca gcgtctaact aaatacacaa
13741  tggctgattt agtctatgct ctacgtcatt ttgatgaggg taattgtgat acattaaaag
13801  aaatactcgt cacatacaat tgctgtgatg atgattattt caataagaag gattggtatg
13861  acttcgtaga gaatcctgac atcttacgcg tatatgctaa cttaggtgag cgtgtacgcc
13921  aatcattatt aaagactgta caattctgcg atgctatgcg tgatgcaggc attgtaggcg
13981  tactgacatt agataatcag gatcttaatg ggaactggta cgatttcggt gatttcgtac
14041  aagtagcacc aggctgcgga gttcctattg tggattcata ttactcattg ctgatgccca
14101  tcctcacttt gactagggca ttggctgctg agtcccatat ggatgctgat ctcgcaaaac
14161  cacttattaa gtgggatttg ctgaaatatg atttacgga agagagactt tgtctcttcg
14221  accgttattt taaatattgg gaccagacat accatcccaa ttgtattaac tgtttggatg
14281  ataggtgtat ccttcattgt gcaaacttta atgtgttatt ttctactgtg tttccaccta
14341  caagttttgg accactagta agaaaaatat ttgtagatgg tgttcctttt gttgtttcaa
14401  ctggataccaa ttttcgtgag ttaggagtcg tacataatca ggatgtaaac ttacatagct
14461  cgcgtctcag tttcaaggaa cttttagtgt atgctgctga tccagctatg catgcagctt
14521  ctggcaattt attgctagat aaacgcacta catgcttttc agtagctgca ctaacaaaca
14581  atgttgcttt tcaaactgtc aaacccggta atttttaataa agacttttat gactttgctg
14641  tgtctaaagg tttttcttaag gaaggaagtt ctgttgaact aaaacacttc ttctttgctc
14701  aggatggcaa cgctgctatc agtgattatg actattatcg ttataatctg ccaacaatgt
14761  gtgatatcag acaactccta ttcgtagttg aagttgttga taaatacttt gattgttacg
14821  atggtggctg tattaatgcc aaccaagtaa tcgttaacaa tctggataaa tcagctggtt
14881  tcccatttaa taaatggggt aaggctagac tttattatga ctcaatgagt tatgaggatc
14941  aagatgcact tttcgcgtat actaagcgta atgtcatccc tactataact caaatgaatc
15001  ttaagtatgc cattagtgca aagaatagag ctcgcaccgt agctggtgtc tctatctgta
15061  gtactatgac aaatagacag tttcatcaga aattattgaa gtcaatagcc gccactagag
15121  gagctactgt ggtaattgga acaagcaagt tttacggtgg ctggcataat atgttaaaaa
15181  ctgtttacag tgatgtagaa actccacacc ttatgggttg ggattatcca aaatgtgaca
15241  gagccatgcc taacatgctt aggataatgg cctctcttgt tcttgctcgc aaacataaca
15301  cttgctgtaa cttatcacac cgtttctaca ggttagctaa cgagtgtgcg caagtattaa
15361  gtgagatggt catgtgtggc ggctcactat atgttaaacc aggtggaaca tcatccggtg
15421  atgctacaac tgcttatgct aatagtgtct ttaacatttg tcaagctgtt acagccaatg
15481  taaatgcact tctttcaact gatggtaata agatagctga caagtatgtc cgcaatctac
15541  aacacaggct ctatgagtgt ctctatagaa atagggatgt tgatcatgaa ttcgtggatg
15601  agttttacgc ttacctgcgt aaacatttct ccatgatgat tctttctgat gatgccgttg
15661  tgtgctataa cagtaactat gcggctcaag gtttagtagc tagcattaag aactttaagg
15721  cagttcttta ttatcaaaat aatgtgttca tgtctgaggc aaaatgttgg actgagactg
15781  accttactaa aggacctcac gaattttgct cacagcatac aatgctagtt aaacaaggag
15841  atgattacgt gtacctgcct tacccagatc catcaagaat attaggcgca ggctgttttg
15901  tcgatgatat tgtcaaaaca gatggtacac ttatgattga aaggttcgtg tcactggcta
15961  ttgatgctta cccacttaca aaacatccta atcaggagta tgctgatgtc tttcacttgt
16021  atttacaata cattagaaag ttacatgatg agcttactgg ccacatgttg gacatgtatt
16081  ccgtaatgct aactaatgat aacacctcac ggtactggga acctgagttt tatgaggcta
16141  tgtacacacc acatacagtc ttgcaggctg taggtgcttg tgtattgtgc aattcacaga
16201  cttcacttcg ttgcggtgcc tgtattagga cccattcct atgttgcaag tgctgctatg
16261  accatgtcat ttcaacatca cacaaattag tgttgtctgt taatcctat gtttgcaatg
16321  ccccaggttg tgatgtcact gatgtgacac aactgtatct aggaggtatg agctattatt
16381  gcaagtcaca taagcctccc attagttttc cattatgtgc taatggtcag gtttttggtt
16441  tatacaaaaa cacatgtgta ggcagtgaca atgtcactga cttcaatgcg atagcaacat
16501  gtgattggac taatgctggc gattacatac ttgccaacac ttgtactgag agactcaagc
16561  ttttcgcagc agaaacgctc aaagccactg aggaaacatt taagctgtca tatggtattg
16621  ccactgtacg cgaagtactc tctgacagag aattgcatct ttcatgggag gttggaaaac
16681  ctagaccacc attgaacaga aactatgtct ttactggtta ccgtgtaact aaaaatagta
16741  aagtacagat tggagagtac acctttgaaa aaggtgacta tggtgatgct gttgtgtaca
```

FIG. 10 Con't

```
16801 gaggtactac gacatacaag ttgaatgttg gtgattactt tgtgttgaca tctcacactg
16861 taatgccact tagtgcacct actctagtgc cacaagagca ctatgtgaga attactggct
16921 tgtacccaac actcaacatc tcagatgagt tttctagcaa tgttgcaaat tatcaaaagg
16981 tcggcatgca aaagtactct acactccaag gaccacctgg tactggtaag agtcattttg
17041 ccatcggact tgctctctat tacccatctg ctcgcatagt gtatacggca tgctctcatg
17101 cagctgttga tgccctatgt gaaaaggcat taaaatattt gcccatagat aaatgtagta
17161 gaatcatacc tgcgcgtgcg cgcgtagagt gttttgataa attcaaagtg aattcaacac
17221 tagaacagta tgttttctgc actgtaaatg cattgccaga acaactgct  gacattgtag
17281 tctttgatga aatctctatg gctactaatt atgacttgag tgttgtcaat gctagacttc
17341 gtgcaaaaca ctacgtctat attggcgatc ctgctcaatt accagccccc cgcacattgc
17401 tgactaaagg cacactagaa ccagaatatt ttaattcagt gtgcagactt atgaaaacaa
17461 taggtccaga catgttcctt ggaacttgtc gccgttgtcc tgctgaaatt gttgacactg
17521 tgagtgcttt agtttatgac aataagctaa aagcacacaa ggataagtca gctcaatgct
17581 tcaaaatgtt ctacaaaggt gttattacac atgatgtttc atctgcaatc aacagacctc
17641 aaataggcgt tgtaagagaa ttcttacac  gcaatcctgc ttggagaaaa gctgttttta
17701 tctcaccttta taattcacag aacgctgtag cttcaaaaat cttaggattg cctacgcaga
17761 ctgttgattc atcacaggagt tctgaatatg actatgtcat attcacacaa actactgaaa
17821 cagcacactc ttgtaatgtc aaccgcttca atgtggctat cacaagggca aaaattggca
17881 ttttgtgcat aatgtctgat agagatcttt atgacaaact gcaatttaca agtctagaaa
17941 taccacgtcg caatgtggct acattacaag cagaaaatgt aactggactt tttaaggact
18001 gtagtaagat cattactggt cttcatccta cacaggcacc tacacacctc agcgttgata
18061 taaaattcaa gactgaagga ttatgtgttg acataccagg cataccaaag gacatgacct
18121 accgtagact catctctatg atgggtttca aaatgaatta ccaagtcaat ggttacccta
18181 atatgtttat cacccgcgaa gaagctattc gtcacgttcg tgcgtggatt ggctttgatg
18241 tagagggctg tcatgcaact agagatgctg tgggtactaa cctacctctc cagctaggat
18301 tttctacagg tgttaactta gtagctgtac cgactggtta tgttgacact gaaaataaca
18361 cagaattcac cagagttaat gcaaaacctc caccaggtga ccagtttaaa catcttatac
18421 cactcatgta taaaggcttg ccctggaatg tagtgcgtat taagatagta caaatgctca
18481 gtgatacact gaaaggattg tcagacagag tcgtgttcgt cctttgggcg catggctttg
18541 agcttacatc aatgaagtac tttgtcaaga ttggacctga aagaacgtgt tgtctgtgtg
18601 acaaacgtgc aacttgcttt tctacttcat cagatactta tgcctgctgg aatcattctg
18661 tgggttttga ctatgtctat aacccattta tgattgatgt tcagcagtgg ggctttacgg
18721 gtaaccttca gagtaaccat gaccaacatt gccaggtaca tggaaatgca catgtggcta
18781 gttgtgatgc tatcatgact agatgtttag cagtccatga gtgctttgtt aagcgcgttg
18841 attggtctgt tgaataccct attataggag atgaactgag ggttaattct gcttgcagaa
18901 aagtacaaca catggttgtg aagtctgcat tgcttgctga taagtttcca gttcttcatg
18961 acattggaaa tccaaaggct atcaagtgtg tgcctcaggc tgaagtagaa tggaagttct
19021 acgatgctca gccatgtagt gacaaagctt acaaaataga ggaactcttc tattcttatg
19081 ctacacatca cgataaattc actgatggtg tttgtttgtt ttggaattgt aacgttgatc
19141 gttacccagc caatgcaatt gtgtgtaggt ttgacacaag agtcttgtca aacttgaact
19201 taccaggctg tgatggtggt agtttgtatg tgaataagca tgcattccac actccagctt
19261 tcgataaaag tgcatttact aatttaaagc aattgccttt cttttactat tctgatagtc
19321 cttgtgagtc tcatggcaaa caagtagtgt cggatattga ttatgttcca ctcaaatctg
19381 ctacgtgtat tacacgatgc aatttaggtg gtgctgtttg cagacaccat gcaaatgagt
19441 accgacagta cttggatgca tataatatga tgatttctgc tggatttagc ctatggattt
19501 acaaacaatt tgatacttat aacctgtgga atacatttac caggttacag agtttagaaa
19561 atgtggctta taatgttgtt aataaggac  actttgatgg acacgccggc gaagcacctg
19621 tttccatcat taataatgct gtttacacaa aggtagatgg tattgatgtg gagatctttg
19681 aaaataagac aacacttcct gttaatgttg catttgagct tgggctaagc gtaacatta
19741 aaccagtgcc agagattaag atactcaata atttgggtgt tgatatcgct gctaatactg
19801 taatctggga ctacaaaaga gaagccccag cacatgtatc tacaataggt gtctgcacaa
19861 tgactgacat tgccaagaaa cctactgaga gtgcttgttc ttcacttact gtcttgtttg
19921 atggtagagt ggaaggacag gtagaccttt ttagaaacgc ccgtaatggt gttttaataa
19981 cagaaggttc agtcaaaggt ctaacacctt caaagggacc agcacaagct agcgtcaatg
20041 gagtcacatt aattggagaa tcagtaaaaa cacagtttaa ctactttaag aaagtagacg
20101 gcattattca acagttgcct gaaacctact ttactcagag cagagacttag gaggatttta
```

FIG. 10 Con't

```
20161 agcccagatc acaaatggaa actgactttc tcgagctcgc tatggatgaa ttcatacagc
20221 gatataagct cgagggctat gccttcgaac acatcgttta tggagatttc agtcatggac
20281 aacttggcgg tcttcattta atgataggct tagccaagcg ctcacaagat tcaccactta
20341 aattagagga ttttatccct atggacagca cagtgaaaaa ttacttcata acagatgcgc
20401 aaacaggttc atcaaaatgt gtgtgttctg tgattgatct tttacttgat gactttgtcg
20461 agataataaa gtcacaagat ttgtcagtga tttcaaaagt ggtcaaggtt acaattgact
20521 atgctgaaat tcattcatg ctttggtgta aggatggaca tgttgaaacc ttctacccaa
20581 aactacaagc aagtcaagcg tggcaaccag gtgttgcgat gcctaacttg tacaagatgc
20641 aagaatgct tcttgaaaag tgtgaccttc agaattatgg tgaaaatgct gttataccaa
20701 aaggaataat gatgaatgtc gcaaagtata ctcaactgtg tcaatactta aatacactta
20761 ctttagctgt accctacaac atgagagtta ttcactttgg tgctggctct gataaaggag
20821 ttgcaccagg tacagctgtg ctcagacaat ggttgccaac tggcacacta cttgtcgatt
20881 cagatcttaa tgacttcgtc tccgacgcag attctacttt aattggagac tgtgcaacag
20941 tacatacggc taataaatgg gaccttatta ttagcgatat gtatgaccct aggaccaaac
21001 atgtgacaaa agagaatgac tctaaagaag ggttttcac ttatctgtgt ggatttataa
21061 agcaaaaact agccctgggt ggttctatag ctgtaaagat aacagagcat tcttggaatg
21121 ctgaccttta caagcttatg ggccatttct catggtggac agcttttgtt acaaatgtaa
21181 atgcatcatc atcggaagca ttttaattg gggctaacta tcttggcaag ccgaaggaac
21241 aaattgatgg ctataccatg catgctaact acattttctg gaggaacaca aatcctatcc
21301 agttgtcttc ctattcactc tttgacatga gcaaatttcc tcttaaatta gaggaactg
21361 ctgtaatgtc tcttaaggag aatcaaatca atgatatgat ttattctctt ctggaaaaag
21421 gtaggcttat cattagagaa acaacagag ttgtggtttc aagtgatatt cttgttaaca
21481 actaaacgaa catgtttatt ttcttattat ttcttactct cactagtggt agtgaccttg
21541 accggtgcac cacttttgat gatgttcaag ctcctaatta cactcaacat acttcatcta
21601 tgaggggggt ttactatcct gatgaaattt ttagatcaga cactctttat ttaactcagg
21661 atttatttct tccatttat tctaatgtta cagggtttca tactattaat catacgtttg
21721 gcaaccctgt catacctttt aaggatggta tttattttgc tgccacagag aaatcaaatg
21781 ttgtccgtgg ttgggttttt ggttctacca tgaacaacaa gtcacagtcg gtgattatta
21841 ttaacaattc tactaatgtt gttatacgag catgtaactt tgaattgtgt gacaacccttt
21901 tctttgctgt ttctaaaccc atgggtacac agacacatac tatgatattc gataatgcat
21961 ttaattgcac tttcgagtac atatctgatg ccttttcgct tgatgtttca gaaaagtcag
22021 gtaattttaa acacttacga gagtttgtgt taaaaataa agatgggttt ctctatgttt
22081 ataaggcta tcaacctata gatgtagttc gtgatctacc ttctggtttt aacactttga
22141 aacctatttt taagttgcct cttggtatta acattacaaa ttttagagcc attcttacag
22201 ccttttcacc tgctcaagac atttggggca cgtcagctgc agcctatttt gttggctatt
22261 taaagccaac tacatttatg ctcaagtatg atgaaaatgg tacaatcaca gatgctgttg
22321 attgttctca aaatccactt gctgaactca aatgctctgt taagagcttt gagattgaca
22381 aaggaattta ccagacctct aatttcaggg ttgttccctc aggagatgtt gtgagattcc
22441 ctaatattac aaacttgtgt ccttttggag aggtttttaa tgctactaaa ttcccttctg
22501 tctatgcatg ggagagaaaa aaaatttcta attgtgttgc tgattactct gtgctctaca
22561 actcaacatt tttttcaacc tttaagtgct atggcgtttc tgccactaag ttgaatgatc
22621 tttgcttctc caatgtctat gcagattctt tgtagtcaa gggagatgat gtaagacaaa
22681 tagcgccagg acaaactggt gttattgctg attataatta taaattgcca gatgatttca
22741 tgggttgtgt ccttgcttgg aatactagga acattgatgc tacttcaact ggtaattata
22801 attataaata taggtatctt agacatggca agcttaggcc ctttgagaga gacatatcta
22861 atgtgccttt ctcccctgat ggcaaacctt gcaccccacc tgctcttaat tgttattggc
22921 cattaaatga ttatggtttt tacaccacta ctggcattgg ctaccaacct tacagagttg
22981 tagtactttc ttttgaactt ttaaatgcac cggccacggt tgtggacca aaattatcca
23041 ctgaccttat taagaaccag tgtgtcaatt ttaatttaa tggactcact ggtactggtg
23101 tgttaactcc ttcttcaaag agatttcaac catttcaaca atttggccgt gatgtttctg
23161 atttcactga ttccgttcga gatcctaaaa catctgaaat attagacatt tcaccttgct
23221 ctttggggg tgtaagtgta attcaccctg aacaaatgc ttcatctgaa gttgctgttc
23281 tatatcaaga tgttaactgc actgatgttt ctacagcaat tcatgcagat caactcacac
23341 cagcttggcg catatattct actggaaaca atgtattcca gactcaagca ggctgtctta
23401 taggagctga gcatgtcgac acttcttatg agtgcgacat tccattggaa ctggcatt
23461 gtgctagtta ccatacagtt tctttattac gtagtactag ccaaaaatct attgtggctt
```

FIG. 10 Con't

```
23521 atactatgtc tttaggtgct gatagttcaa ttgcttactc taataacacc attgctatac
23581 ctactaactt ttcaattagc attactacag aagtaatgcc tgtttctatg gctaaaacct
23641 ccgtagattg taatatgtac atctgcggag attctactga atgtgctaat ttgcttctcc
23701 aatatggtag cttttgcaca caactaaatc gtgcactctc aggtattgct gctgaacagg
23761 atcgcaacac acgtgaagtg ttcgctcaag tcaaacaaat gtacaaaacc ccaactttga
23821 aatattttgg tggttttaat ttttcacaaa tattacctga ccctctaaag ccaactaaga
23881 ggtcttttat tgaggacttg ctctttaata aggtgacact cgctgatgct ggcttcatga
23941 agcaatatgg cgaatgccta ggtgatatta atgctagaga tctcatttgt gcgcagaagt
24001 tcaatggact tacagtgttg ccacctctgc tcactgatga tatgattgct gcctacactg
24061 ctgctctagt tagtggtact gccactgctg atggacatt tggtgctggc gctgctcttc
24121 aaataccttt tgctatgcaa atggcatata ggttcaatgg cattggagtt acccaaaatg
24181 ttctctatga gaaccaaaaa caaatcgcca accaatttaa caaggcgatt agtcaaattc
24241 aagaatcact tacaacaaca tcaactgcat gggcaagct gcaagacgtt gttaaccaga
24301 atgctcaagc attaaacaca cttgttaaac aacttagctc taattttggt gcaatttcaa
24361 gtgtgctaaa tgatatcctt tcgcgacttg ataaagtcga ggcggaggta caaattgaca
24421 ggttaattac aggcagactt caaagccttc aaacctatgt aacacaacaa ctaatcaggg
24481 ctgctgaaat cagggcttct gctaatcttg ctgctactaa atgtctgag tgtgttcttg
24541 gacaatcaaa aagagttgac ttttgtggaa agggctacca ccttatgtcc ttcccacaag
24601 cagccccgca tggtgttgtc ttcctacatg tcacgtatgt gccatcccag gagaggaact
24661 tcaccacagc gccagcaatt tgtcatgaag gcaaagcata cttccctcgt gaaggtgttt
24721 ttgtgtttaa tggcacttct tggtttatta cacagaggaa cttcttttct ccacaaataa
24781 ttactacaga caatacattt gtctcaggaa attgtgatgt cgttattggc atcattaaca
24841 acacagttta tgatcctctg caacctgagc ttgactcatt caaagaagag ctggacaagt
24901 acttcaaaaa tcatacatca ccagatgttg atcttggcga catttcaggc attaacgctt
24961 ctgtcgtcaa cattcaaaaa gaaattgacc gcctcaatga ggtcgctaaa aatttaaatg
25021 aatcactcat tgaccttcaa gaattgggaa atatgagca atatattaaa tggccttggt
25081 atgtttggct cggcttcatt gctggactaa ttgccatcgt catggttaca atcttgcttt
25141 gttgcatgac tagttgttgc agttgcctca agggtgcatg ctcttgtggt tcttgctgca
25201 agtttgatga ggatgactct gagccagttc tcaagggtgt caaattacat tacacataaa
25261 cgaacttatg gatttgttta tgagattttt tactcttgga tcaattactg cacagccagt
25321 aaaaattgac aatgcttctc ctgcaagtac tgttcatgct acagcaacga taccgctaca
25381 agcctcactc cctttcggat ggcttgttat tggcgttgca tttcttgctg ttttcagag
25441 cgctaccaaa ataattgcgc tcaataaaag atggcagcta gccctttata agggcttcca
25501 gttcatttgc aatttactgc tgctatttgt taccatctat tcacatcttt tgcttgtcgc
25561 tgcaggtaag gaggcgcaat ttttgtacct ctatgccttg atatattttc tacaatgcat
25621 caacgcatgt agaattatta tgagatgttg ctttgttgg aagtgcaaat ccaagaaccc
25681 attactttat gatgccaact actttgtttg ctggcacaca cataactatg actactgtat
25741 accatataac agtgtcacag atacaattgt cgttactgaa ggtgacggca tttcaacacc
25801 aaaactcaaa gaagactacc aaattggtgg ttattctgag gataggcact caggtgttaa
25861 agactatgtc gttgtacatg gctatttcac cgaagtttac taccagcttg agtctacaca
25921 aattactaca gacactggta ttgaaaatgc tacattcttc atctttaaca gcttgttaa
25981 agacccaccg aatgtgcaaa tacacacaat cgacggctct caggagttg ctaatccagc
26041 aatggatcca atttatgatg agccgacgac gactactagc gtgcctttgt aagcacaaga
26101 aagtgagtac gaacttatgt actcattcgt tcggaagaa acaggtacgt taatagttaa
26161 tagcgtactt ctttttcttg ctttcgtggt attcttgcta gtcacactag ccatccttac
26221 tgcgcttcga ttgtgtgcgt actgctgcaa tattgttaac gtgagtttag taaaaccaac
26281 ggtttacgtc tactcgcgtg ttaaaaatct gaactcttct gaaggagttc ctgatcttct
26341 ggtctaaacg aactaactat tattattatt ctgtttggaa ctttaacatt gcttatcatg
26401 gcagacaacg gtactattac cgttgaggag cttaaacaac tcctggaaca atggaaccta
26461 gtaataggtt tcctattcct agcctggatt atgttactac aatttgccta ttctaatcgg
26521 aacaggtttt tgtacataat aaagcttgtt ttcctctggc tcttgtggcc agtaacactt
26581 gcttgttttg tgcttgctgt tgtctacaga attaattggg tgactggcgg gattgcgatt
26641 gcaatggctt gtattgtagg cttgatgtgg cttagctact tcgttgcttc cttcaggctg
26701 tttgctcgta cccgctcaat gtggcattc aacccagaaa caaacattct tctcaatgtg
26761 cctctccggg ggacaattgt gaccagaccg ctcatggaaa gtgaacttgt cattggtgct
26821 gtgatcattc gtggtcactt gcgaatggcc ggacactccc tagggcgctg tgacattaag
```

FIG. 10 Con't

```
26881 gacctgccaa aagagatcac tgtggctaca tcacgaacgc tttcttatta caaattagga
26941 gcgtcgcagc gtgtaggcac tgattcaggt tttgctgcat acaaccgcta ccgtattgga
27001 aactataaat taaatacaga ccacgccggt agcaacgaca atattgcttt gctagtacag
27061 taagtgacaa cagatgtttc atcttgttga cttccaggtt acaatagcag agatattgat
27121 tatcattatg aggactttca ggattgctat ttggaatctt gacgttataa taagttcaat
27181 agtgagacaa ttatttaagc ctctaactaa gaagaattat tcggagttag atgatgaaga
27241 acctatggag ttagattatc cataaaacga acatgaaaat tattctcttc ctgacattga
27301 ttgtatttac atcttgcgag ctatatcact atcaggagtg tgttagaggt acgactgtac
27361 tactaaaaga accttgccca tcaggaacat acgagggcaa ttcaccattt caccctcttg
27421 ctgacaataa atttgcacta acttgcacta gcacacactt tgcttttgct tgtgctgacg
27481 gtactcgaca tacctatcag ctgcgtgcaa gatcagtttc accaaaactt ttcatcagac
27541 aagaggaggt tcaacaagag ctctactcgc cactttttct cattgttgct gctctagtat
27601 ttttaatact ttgcttcacc attaagagaa agacagaatg aatgagctca ctttaattga
27661 cttctatttg tgcttttttag cctttctgct attccttgtt ttaataatgc ttattatatt
27721 ttggttttca ctcgaaatcc aggatctaga agaaccttgt accaaagtct aaacgaacat
27781 gaaacttctc attgttttga cttgtatttc tctatgcagt tgcatatgca ctgtagtaca
27841 gcgctgtgca tctaataaac ctcatgtgct tgaagatcct tgtaaggtac aacactaggg
27901 gtaatactta tagcactgct tggctttgtg ctctaggaaa ggttttacct tttcatagat
27961 ggcacactat ggttcaaaca tgcacaccta atgttactat caactgtcaa gatccagctg
28021 gtggtgcgct tatagctagg tgttggtacc ttcatgaagg tcaccaaact gctgcattta
28081 gagacgtact tgttgtttta aataaacgaa caaattaaaa tgtctgataa tggaccccaa
28141 tcaaaccaac gtagtgcccc ccgcattaca tttggtggac ccacagattc aactgacaat
28201 aaccagaatg gaggacgcaa tggggcaagg ccaaaacagc gccgacccca aggtttaccc
28261 aataatactg cgtcttggtt cacagctctc actcagcatg gcaaggagga acttagattc
28321 cctcgaggcc agggcgttcc aatcaacacc aatagtggtc cagatgacca aattggctac
28381 taccgaagag ctacccgacg agttcgtggt ggtgacggca aaatgaaaga gctcagcccc
28441 agatggtact tctattacct aggaactggc ccagaagctt cacttcccta cggcgctaac
28501 aaagaaggca tcgtatgggt tgcaactgag ggagccttga atacacccaa agaccacatt
28561 ggcacccgca atcctaataa caatgctgcc accgtgctac aacttcctca aggaacaaca
28621 ttgccaaaag gcttctacgc agagggaagc agaggcggca gtcaagcctc ttctcgctcc
28681 tcatcacgta gtcgcggtaa ttcaagaaat tcaactcctg gcagcagtag gggaaattct
28741 cctgctcgaa tggctagcgg aggtggtgaa actgccctcg cgctattgct gctagacaga
28801 ttgaaccagc ttgagagcaa agtttctggt aaaggccaac aacaacaagg ccaaactgtc
28861 actaagaaat ctgctgctga ggcatctaaa aagcctcgcc aaaaacgtac tgccacaaaa
28921 cagtacaacg tcactcaagc atttgggaga cgtggtccag aacaaaccca aggaaatttc
28981 ggggaccaag acctaatcag acaaggaact gattacaaac attggccgca aattgcacaa
29041 tttgctccaa gtgcctctgc attctttgga atgtcacgca ttggcatgga agtcacacct
29101 tcgggaacat ggctgactta tcatggagcc attaaattgg atgacaaaga tccacaattc
29161 aaagacaacg tcatactgct gaacaagcac attgacgcat acaaaacatt cccaccaaca
29221 gagcctaaaa aggacaaaaa gaaaaagact gatgaagctc agccttgcc gcagagacaa
29281 aagaagcagc ccactgtgac tcttcttcct gcggctgaca tggatgattt ctccagacaa
29341 cttcaaaatt ccatgagtgg agcttctgct gattcaactc aggcataaac actcatgatg
29401 accacacaag gcagatgggc tatgtaaacg ttttcgcaat tccgtttacg atacatagtc
29461 tactcttgtg cagaatgaat tctcgtaact aaacagcaca gtaggtttta gttaacttta
29521 atctcacata gcaatcttta atcaatgtgt aacattaggg aggacttgaa agagccacca
29581 cattttcatc gaggccacgc ggagtacgat cgagggtaca gtgaataatg ctagggagag
29641 ctgcctatat ggaagagccc taatgtgtaa aattaatttt agtagtgcta tccccatgtg
29701 attttaatag cttcttagga gaatgacaaa aaaaaaaaaa aa
```

FIG. 1O Con't

```
  1 - ATATTAGGTTTTTACCTACCCAGGAAAAGCCAACCAACCTCGATCTCTTGTAGATCTGTT -  60
    -  I  L  G  F  Y  L  P  R  K  S  Q  P  T  S  I  S  C  R  S  V
    -   Y  *  V  F  T  Y  P  G  K  A  N  Q  P  R  S  L  V  D  L  F
    -    I  R  F  L  P  T  Q  E  K  P  T  N  L  D  L  L  *  I  C  S
 61 - CTCTAAACGAACTTTAAAATCTGTGTAGCTGTCGCTCGGCTGCATGCCTAGTGCACCTAC - 120
    -  L  *  T  N  F  K  I  C  V  A  V  A  R  L  H  A  *  C  T  Y
    -   S  K  R  T  L  K  S  V  *  L  S  L  G  C  M  P  S  A  P  T
    -    L  N  E  L  *  N  L  C  S  C  R  S  A  A  C  L  V  H  L  R
121 - GCAGTATAAACAATAATAAATTTTACTGTCGTTGACAAGAAACGAGTAACTCGTCCCTCT - 180
    -  A  V  *  T  I  I  N  F  T  V  V  D  K  K  R  V  T  R  P  S
    -   Q  Y  K  Q  *  *  I  L  L  S  L  T  R  N  E  *  L  V  P  L
    -    S  I  N  N  N  K  F  Y  C  R  *  Q  E  T  S  N  S  S  L  F
181 - TCTGCAGACTGCTTACGGTTTCGTCCGTGTTGCAGTCGATCATCAGCATACCTAGGTTTC - 240
    -  S  A  D  C  L  R  F  R  P  C  C  S  R  S  S  A  Y  L  G  F
    -   L  Q  T  A  Y  G  F  V  R  V  A  V  D  H  Q  T  *  V  S
    -    C  R  L  L  T  V  S  S  V  L  Q  S  I  I  S  I  P  R  F  R
241 - GTCCGGGTGTGACCGAAAGGTAAGATGGAGAGCCTTGTTCTTGGTGTCAACGAGAAAACA - 300
    -  V  R  V  *  P  K  G  K  M  E  S  L  V  L  G  V  N  E  K  T
    -   S  G  C  D  R  K  V  R  W  R  A  L  F  L  V  S  T  R  K  H
    -    P  G  V  T  E  R  *  D  G  E  P  C  S  W  C  Q  R  E  N  T
301 - CACGTCCAACTCAGTTTGCCTGTCCTTCAGGTTAGAGACGTGCTAGTGCGTGGCTTCGGG - 360
    -  H  V  Q  L  S  L  P  V  L  Q  V  R  D  V  L  V  R  G  F  G
    -   T  S  N  S  V  C  L  S  F  R  L  E  T  C  *  C  V  A  S  G
    -    R  P  T  Q  F  A  C  P  S  G  *  R  R  A  S  A  W  L  R  G
361 - GACTCTGTGGAAGAGGCCCTATCGGAGGCACGTGAACACCTCAAAAATGGCACTTGTGGT - 420
    -  D  S  V  E  E  A  L  S  E  A  R  E  H  L  K  N  G  T  C  G
    -   T  L  W  K  R  P  Y  R  R  H  V  N  T  S  K  M  A  L  V  V
    -    L  C  G  R  G  P  I  G  G  T  *  T  P  Q  K  W  H  L  W  S
421 - CTAGTAGAGCTGGAAAAAGGCGTACTGCCCCAGCTTGAACAGCCCTATGTGTTCATTAAA - 480
    -  L  V  E  L  E  K  G  V  L  P  Q  L  E  Q  P  Y  V  F  I  K
    -   *  *  S  W  K  K  A  Y  C  P  S  L  N  S  P  M  C  S  L  N
    -    S  R  A  G  K  R  R  T  A  P  A  *  T  A  L  C  V  H  *  T
481 - CGTTCTGATGCCTTAAGCACCAATCACGGCCACAAGGTCGTTGAGCTGGTTGCAGAAATG - 540
    -  R  S  D  A  L  S  T  N  H  G  H  K  V  V  E  L  V  A  E  M
    -   V  L  M  P  *  A  P  I  T  A  T  R  S  L  S  W  L  Q  K  W
    -    F  *  C  L  K  H  Q  S  R  P  Q  G  R  *  A  G  C  R  N  G
541 - GACGGCATTCAGTACGGTCGTAGCGGTATAACACTGGGAGTACTCGTGCCACATGTGGGC - 600
    -  D  G  I  Q  Y  G  R  S  G  I  T  L  G  V  L  V  P  H  V  G
    -   T  A  F  S  T  V  V  A  V  *  H  W  E  Y  S  C  H  M  W  A
    -    R  H  S  V  R  S  *  R  Y  N  T  G  S  T  R  A  T  C  G  R
601 - GAAACCCCAATTGCATACCGCAATGTTCTTCTTCGTAAGAACGGTAATAAGGGAGCCGGT - 660
    -  E  T  P  I  A  Y  R  N  V  L  L  R  K  N  G  N  K  G  A  G
    -   K  P  Q  L  H  T  A  M  F  F  F  V  R  T  V  I  R  E  P  V
    -    N  P  N  C  I  P  Q  C  S  S  S  *  E  R  *  *  G  S  R  W
661 - GGTCATAGCTATGGCATCGATCTAAAGTCTTATGACTTAGGTGACGAGCTTGGCACTGAT - 720
    -  G  H  S  Y  G  I  D  L  K  S  Y  D  L  G  D  E  L  G  T  D
    -   V  I  A  M  A  S  I  *  S  L  M  T  *  V  T  S  L  A  L  I
    -    S  *  L  W  H  R  S  K  V  L  *  L  R  *  R  A  W  H  *  S
721 - CCCATTGAAGATTATGAACAAAACTGGAACACTAAGCATGGCAGTGGTGCACTCCGTGAA - 780
    -  P  I  E  D  Y  E  Q  N  W  N  T  K  H  G  S  G  A  L  R  E
    -   P  L  K  I  M  N  K  T  G  T  L  S  M  A  V  V  H  S  V  N
    -    H  *  R  L  *  T  K  L  E  H  *  A  W  Q  W  C  T  P  *  T
781 - CTCACTCGTGAGCTCAATGGAGGTGCAGTCACTCGCTATGTCGACAACAATTTCTGTGGC - 840
    -  L  T  R  E  L  N  G  G  A  V  T  R  Y  V  D  N  N  F  C  G
    -   S  L  V  S  S  M  E  V  Q  S  L  A  M  S  T  T  I  S  V  A
    -    H  S  *  A  Q  W  R  C  S  H  S  L  C  R  Q  Q  F  L  W  P
```

FIG. 11

```
 841 - CCAGATGGGTACCCTCTTGATTGCATCAAAGATTTTCTCGCACGCGCGGGCAAGTCAATG -  900
     -  P  D  G  Y  P  L  D  C  I  K  D  F  L  A  R  A  G  K  S  M
     -   Q  M  G  T  L  L  I  A  S  K  I  F  S  H  A  R  A  S  Q  C
     -    R  W  V  P  S  *  L  H  Q  R  F  S  R  T  R  G  Q  V  N  V
 901 - TGCACTCTTTCCGAACAACTTGATTACATCGAGTCGAAGAGAGGTGTCTACTGCTGCCGT -  960
     -  C  T  L  S  E  Q  L  D  Y  I  E  S  K  R  G  V  Y  C  C  R
     -   A  L  F  P  N  N  L  I  T  S  S  R  R  E  V  S  T  A  A  V
     -    H  S  F  R  T  T  *  L  H  R  V  E  E  R  C  L  L  L  P  *
 961 - GACCATGAGCATGAAATTGCCTGGTTCACTGAGCGCTCTGATAAGAGCTACGAGCACCAG - 1020
     -  D  H  E  H  E  I  A  W  F  T  E  R  S  D  K  S  Y  E  H  Q
     -   T  M  S  M  K  L  P  G  S  L  S  A  L  I  R  A  T  S  T  R
     -    P  *  A  *  N  C  L  V  H  *  A  L  *  *  E  L  R  A  P  D
1021 - ACACCCTTCGAAATTAAGAGTGCCAAGAAATTTGACACTTTCAAAGGGGAATGCCCAAAG - 1080
     -  T  P  F  E  I  K  S  A  K  K  F  D  T  F  K  G  E  C  P  K
     -   H  P  S  K  L  R  V  P  R  N  L  T  L  S  K  G  N  A  Q  S
     -    T  L  R  N  *  E  C  Q  E  I  *  H  F  Q  R  G  M  P  K  V
1081 - TTTGTGTTTCCTCTTAACTCAAAAGTCAAAGTCATTCAACCACGTGTTGAAAAGAAAAAG - 1140
     -  F  V  F  P  L  N  S  K  V  K  V  I  Q  P  R  V  E  K  K  K
     -   L  C  F  L  L  T  Q  K  S  K  S  F  N  H  V  L  K  R  K  R
     -    C  V  S  S  *  L  K  S  Q  S  H  S  T  T  C  *  K  E  K  D
1141 - ACTGAGGGTTTCATGGGGCGTATACGCTCTGTGTACCCTGTTGCATCTCCACAGGAGTGT - 1200
     -  T  E  G  F  M  G  R  I  R  S  V  Y  P  V  A  S  P  Q  E  C
     -   L  R  V  S  W  G  V  Y  A  L  C  T  L  L  H  L  H  R  S  V
     -    *  G  F  H  G  A  Y  T  L  C  V  P  C  C  I  S  T  G  V  *
1201 - AACAATATGCACTTGTCTACCTTGATGAAATGTAATCATTGCGATGAAGTTTCATGGCAG - 1260
     -  N  N  M  H  L  S  T  L  M  K  C  N  H  C  D  E  V  S  W  Q
     -   T  I  C  T  C  L  P  *  *  N  V  I  I  A  M  K  F  H  G  R
     -    Q  Y  A  L  V  Y  L  D  E  M  *  S  L  R  *  S  F  M  A  D
1261 - ACGTGCGACTTTCTGAAAGCCACTTGTGAACATTGTGGCACTGAAAATTTAGTTATTGAA - 1320
     -  T  C  D  F  L  K  A  T  C  E  H  C  G  T  E  N  L  V  I  E
     -   R  A  T  F  *  K  P  L  V  N  I  V  A  L  K  I  *  L  L  K
     -    V  R  L  S  E  S  H  L  *  T  L  W  H  *  K  F  S  Y  *  R
1321 - GGACCTACTACATGTGGGTACCTACCTACTAATGCTGTAGTGAAAATGCCATGTCCTGCC - 1380
     -  G  P  T  T  C  G  Y  L  P  T  N  A  V  V  K  M  P  C  P  A
     -   D  L  L  H  V  G  T  Y  L  L  M  L  *  *  K  C  H  V  L  P
     -    T  Y  Y  M  W  V  P  T  Y  *  C  C  S  E  N  A  M  S  C  L
1381 - TGTCAAGACCCAGAGATTGGACCTGAGCATAGTGTTGCAGATTATCACAACCACTCAAAC - 1440
     -  C  Q  D  P  E  I  G  P  E  H  S  V  A  D  Y  H  N  H  S  N
     -   V  K  T  Q  R  L  D  L  S  I  V  L  Q  I  I  T  T  T  Q  T
     -    S  R  P  R  D  W  T  *  A  *  C  C  R  L  S  Q  P  L  K  H
1441 - ATTGAAACTCGACTCCGCAAGGGAGGTAGGACTAGATGTTTTGGAGGCTGTGTGTTTGCC - 1500
     -  I  E  T  R  L  R  K  G  G  R  T  R  C  F  G  G  C  V  F  A
     -   L  K  L  D  S  A  R  E  V  G  L  D  V  L  E  A  V  C  L  P
     -    *  N  S  T  P  Q  G  R  *  D  *  M  F  W  R  L  C  V  C  L
1501 - TATGTTGGCTGCTATAATAAGCGTGCCTACTGGGTTCCTCGTGCTAGTGCTGATATTGGC - 1560
     -  Y  V  G  C  Y  N  K  R  A  Y  W  V  P  R  A  S  A  D  I  G
     -   M  L  A  A  I  I  S  V  P  T  G  F  L  V  L  V  L  I  L  A
     -    C  W  L  L  *  *  A  C  L  L  G  S  S  C  *  C  *  Y  W  L
1561 - TCAGGCCATACTGGCATTACTGGTGACAATGTGGAGACCTTGAATGAGGATCTCCTTGAG - 1620
     -  S  G  H  T  G  I  T  G  D  N  V  E  T  L  N  E  D  L  L  E
     -   Q  A  I  L  A  L  L  V  T  M  W  R  P  *  M  R  I  S  L  R
     -    R  P  Y  W  H  Y  W  *  Q  C  G  D  L  E  *  G  S  P  *  D
1621 - ATACTGAGTCGTGAACGTGTTAACATTAACATTGTTGGCGATTTTCATTTGAATGAAGAG - 1680
     -  I  L  S  R  E  R  V  N  I  N  I  V  G  D  F  H  L  N  E  E
     -   Y  *  V  V  N  V  L  T  L  T  L  L  A  I  F  I  *  M  K  R
     -    T  E  S  *  T  C  *  H  *  H  C  W  R  F  S  F  E  *  R  G
```

FIG. 11 Con't

```
1681 - GTTGCCATCATTTTGGCATCTTTCTCTGCTTCTACAAGTGCCTTTATTGACACTATAAAG - 1740
     - V  A  I  I  L  A  S  F  S  A  S  T  S  A  F  I  D  T  I  K
     -  L  P  S  F  W  H  L  S  L  L  Q  V  P  L  L  T  L  *  R
     -   C  H  H  F  G  I  F  L  C  F  Y  K  C  L  Y  *  H  Y  K  E
1741 - AGTCTTGATTACAAGTCTTTCAAAACCATTGTTGAGTCCTGCGGTAACTATAAAGTTACC - 1800
     - S  L  D  Y  K  S  F  K  T  I  V  E  S  C  G  N  Y  K  V  T
     - V  L  I  T  S  L  S  K  P  L  L  S  P  A  V  T  I  K  L  P
     -  S  *  L  Q  V  F  Q  N  H  C  *  V  L  R  *  L  *  S  Y  Q
1801 - AAGGGAAAGCCCGTAAAAGGTGCTTGGAACATTGGACAACAGAGATCAGTTTTAACACCA - 1860
     - K  G  K  P  V  K  G  A  W  N  I  G  Q  Q  R  S  V  L  T  P
     - R  E  S  P  *  K  V  L  G  T  L  D  N  R  D  Q  F  *  H  H
     -  G  K  A  R  K  R  C  L  E  H  W  T  T  E  I  S  F  N  T  T
1861 - CTGTGTGGTTTTCCCTCACAGGCTGCTGGTGTTATCAGATCAATTTTTGCGCGCACACTT - 1920
     - L  C  G  F  P  S  Q  A  A  G  V  I  R  S  I  F  A  R  T  L
     - C  V  V  F  P  H  R  L  L  V  L  S  D  Q  F  L  R  A  H  L
     -  V  W  F  S  L  T  G  C  W  C  Y  Q  I  N  F  C  A  H  T  *
1921 - GATGCAGCAAACCACTCAATTCCTGATTTGCAAAGAGCAGCTGTCACCATACTTGATGGT - 1980
     - D  A  A  N  H  S  I  P  D  L  Q  R  A  A  V  T  I  L  D  G
     - M  Q  Q  T  T  Q  F  L  I  C  K  E  Q  L  S  P  Y  L  M  V
     -  C  S  K  P  L  N  S  *  F  A  K  S  S  C  H  H  T  *  W  Y
1981 - ATTTCTGAACAGTCATTACGTCTTGTCGACGCCATGGTTTATACTTCAGACCTGCTCACC - 2040
     - I  S  E  Q  S  L  R  L  V  D  A  M  V  Y  T  S  D  L  L  T
     - F  L  N  S  H  Y  V  L  S  T  P  W  F  I  L  Q  T  C  S  P
     -  F  *  T  V  I  T  S  C  R  R  H  G  L  Y  F  R  P  A  H  Q
2041 - AACAGTGTCATTATTATGGCATATGTAACTGGTGGTCTTGTACAACAGACTTCTCAGTGG - 2100
     - N  S  V  I  I  M  A  Y  V  T  G  G  L  V  Q  Q  T  S  Q  W
     - T  V  S  L  L  W  H  M  *  L  V  V  L  Y  N  R  L  L  S  G
     -  Q  C  H  Y  Y  G  I  C  N  W  W  S  C  T  T  D  F  S  V  V
2101 - TTGTCTAATCTTTTGGGCACTACTGTTGAAAAACTCAGGCCTATCTTTGAATGGATTGAG - 2160
     - L  S  N  L  L  G  T  T  V  E  K  L  R  P  I  F  E  W  I  E
     - C  L  I  F  W  A  L  L  L  K  N  S  G  L  S  L  N  G  L  R
     -  V  *  S  F  G  H  Y  C  *  K  T  Q  A  Y  L  *  M  D  *  G
2161 - GCGAAACTTAGTGCAGGAGTTGAATTTCTCAAGGATGCTTGGGAGATTCTCAAATTTCTC - 2220
     - A  K  L  S  A  G  V  E  F  L  K  D  A  W  E  I  L  K  F  L
     - R  N  L  V  Q  E  L  N  F  S  R  M  L  G  R  F  S  N  F  S
     -  E  T  *  C  R  S  *  I  S  Q  G  C  L  G  D  S  Q  I  S  H
2221 - ATTACAGGTGTTTTTGACATCGTCAAGGGTCAAATACAGGTTGCTTCAGATAACATCAAG - 2280
     - I  T  G  V  F  D  I  V  K  G  Q  I  Q  V  A  S  D  N  I  K
     - L  Q  V  F  L  T  S  S  R  V  K  Y  R  L  L  Q  I  T  S  R
     -  Y  R  C  F  *  H  R  Q  G  S  N  T  G  C  F  R  *  H  Q  G
2281 - GATTGTGTAAAATGCTTCATTGATGTTGTTAACAAGGCACTCGAAATGTGCATTGATCAA - 2340
     - D  C  V  K  C  F  I  D  V  V  N  K  A  L  E  M  C  I  D  Q
     - I  V  *  N  A  S  L  M  L  L  T  R  H  S  K  C  A  L  I  K
     -  L  C  K  M  L  H  *  C  C  *  Q  G  T  R  N  V  H  *  S  S
2341 - GTCACTATCGCTGGCGCAAAGTTGCGATCACTCAACTTAGGTGAAGTCTTCATCGCTCAA - 2400
     - V  T  I  A  G  A  K  L  R  S  L  N  L  G  E  V  F  I  A  Q
     - S  L  S  L  A  Q  S  C  D  H  S  T  *  V  K  S  S  S  L  K
     -  H  Y  R  W  R  K  V  A  I  T  Q  L  R  *  S  L  H  R  S  K
2401 - AGCAAGGGACTTTACCGTCAGTGTATACGTGGCAAGGAGCAGCTGCAACTACTCATGCCT - 2460
     - S  K  G  L  Y  R  Q  C  I  R  G  K  E  Q  L  Q  L  L  M  P
     - A  R  D  F  T  V  S  V  Y  V  A  R  S  S  C  N  Y  S  C  L
     -  Q  G  T  L  P  S  V  Y  T  W  Q  G  A  A  A  T  T  H  A  S
2461 - CTTAAGGCACCAAAAGAAGTAACCTTTCTTGAAGGTGATTCACATGACACAGTACTTACC - 2520
     - L  K  A  P  K  E  V  T  F  L  E  G  D  S  H  D  T  V  L  T
     - L  R  H  Q  K  K  *  P  F  L  K  V  I  H  M  T  Q  Y  L  P
     -  *  G  T  K  R  S  N  L  S  *  R  *  F  T  *  H  S  T  Y  L
```

FIG. 11 Con't

```
2521 - TCTGAGGAGGTTGTTCTCAAGAACGGTGAACTCGAAGCACTCGAGACGCCCGTTGATAGC - 2580
     - S  E  E  V  V  L  K  N  G  E  L  E  A  L  E  T  P  V  D  S
     -  L  R  R  L  F  S  R  T  V  N  S  K  H  S  R  R  P  L  I  A
     -   *  G  G  C  S  Q  E  R  *  T  R  S  T  R  D  A  R  *  *  L
2581 - TTCACAAATGGAGCTATCGTCGGCACACCAGTCTGTGTAAATGGCCTCATGCTCTTAGAG - 2640
     - F  T  N  G  A  I  V  G  T  P  V  C  V  N  G  L  M  L  L  E
     -  S  Q  M  E  L  S  S  A  H  Q  S  V  *  M  A  S  C  S  *  R
     -   H  K  W  S  Y  R  R  R  H  T  S  L  C  K  W  P  H  A  L  R  D
2641 - ATTAAGGACAAAGAACAATACTGCGCATTGTCTCCTGGTTTACTGGCTACAAACAATGTC - 2700
     - I  K  D  K  E  Q  Y  C  A  L  S  P  G  L  L  A  T  N  N  V
     -  L  R  T  K  N  N  T  A  H  C  L  L  V  Y  W  L  Q  T  M  S
     -   *  G  Q  R  T  I  L  R  I  V  S  W  F  T  G  Y  K  Q  C  L
2701 - TTTCGCTTAAAAGGGGGTGCACCAATTAAAGGTGTAACCTTTGGAGAAGATACTGTTTGG - 2760
     - F  R  L  K  G  G  A  P  I  K  G  V  T  F  G  E  D  T  V  W
     -  F  A  *  K  G  V  H  Q  L  K  V  *  P  L  E  K  I  L  F  G
     -   S  L  K  R  G  C  T  N  *  R  C  N  L  W  R  R  Y  C  L  G
2761 - GAAGTTCAAGGTTACAAGAATGTGAGAATCACATTTGAGCTTGATGAACGTGTTGACAAA - 2820
     - E  V  Q  G  Y  K  N  V  R  I  T  F  E  L  D  E  R  V  D  K
     -  K  F  K  V  T  R  M  *  E  S  H  L  S  L  M  N  V  L  T  K
     -   S  S  R  L  Q  E  C  E  N  H  I  *  A  *  *  T  C  *  Q  S
2821 - GTGCTTAATGAAAAGTGCTCTGTCTACACTGTTGAATCCGGTACCGAAGTTACTGAGTTT - 2880
     - V  L  N  E  K  C  S  V  Y  T  V  E  S  G  T  E  V  T  E  F
     -  C  L  M  K  S  A  L  S  T  L  L  N  P  V  P  K  L  L  S  L
     -   A  *  *  K  V  L  C  L  H  C  *  I  R  Y  R  S  Y  *  V  C
2881 - GCATGTGTTGTAGCAGAGGCTGTTGTGAAGACTTTACAACCAGTTTCTGATCTCCTTACC - 2940
     - A  C  V  V  A  E  A  V  V  K  T  L  Q  P  V  S  D  L  L  T
     -  H  V  L  *  Q  R  L  L  *  R  L  Y  N  Q  F  L  I  S  L  P
     -   M  C  C  S  R  G  C  C  E  D  F  T  T  S  F  *  S  P  Y  Q
2941 - AACATGGGTATTGATCTTGATGAGTGGAGTGTAGCTACATTCTACTTATTTGATGATGCT - 3000
     - N  M  G  I  D  L  D  E  W  S  V  A  T  F  Y  L  F  D  D  A
     -  T  W  V  L  I  L  M  S  G  V  *  L  H  S  T  Y  L  M  M  L
     -   H  G  Y  *  S  *  *  V  E  C  S  Y  I  L  L  I  *  *  C  W
3001 - GGTGAAGAAAACTTTTCATCACGTATGTATTGTTCCTTTTACCCTCCAGATGAGGAAGAA - 3060
     - G  E  E  N  F  S  S  R  M  Y  C  S  F  Y  P  P  D  E  E  E
     -  V  K  K  T  F  H  H  V  C  I  V  P  F  T  L  Q  M  R  K  K
     -   *  R  K  L  F  I  T  Y  V  L  F  L  L  P  S  R  *  G  R  R
3061 - GAGGACGATGCAGAGTGTGAGGAAGAAGAAATTGATGAAACCTGTGAACATGAGTACGGT - 3120
     - E  D  D  A  E  C  E  E  E  E  I  D  E  T  C  E  H  E  Y  G
     -  R  T  M  Q  S  V  R  K  K  K  L  M  K  P  V  N  M  S  T  V
     -   G  R  C  R  V  *  G  R  R  N  *  *  N  L  *  T  *  V  R  Y
3121 - ACAGAGGATGATTATCAAGGTCTCCCTCTGGAATTTGGTGCCTCAGCTGAAACAGTTCGA - 3180
     - T  E  D  D  Y  Q  G  L  P  L  E  F  G  A  S  A  E  T  V  R
     -  Q  R  M  I  I  K  V  S  L  W  N  L  V  P  Q  L  K  Q  F  E
     -   R  G  *  L  S  R  S  P  S  G  I  W  C  L  S  *  N  S  S  S
3181 - GTTGAGGAAGAAGAAGAGGAAGACTGGCTGGATGATACTACTGAGCAATCAGAGATTGAG - 3240
     - V  E  E  E  E  E  D  W  L  D  D  T  T  E  Q  S  E  I  E
     -  L  R  K  K  K  R  K  T  G  W  M  I  L  L  S  N  Q  R  L  S
     -   *  G  R  R  R  G  R  L  A  G  *  Y  Y  *  A  I  R  D  *  A
3241 - CCAGAACCAGAACCTACACCTGAAGAACCAGTTAATCAGTTACTGGTTATTTAAACTT - 3300
     - P  E  P  E  P  T  P  E  E  P  V  N  Q  F  T  G  Y  L  K  L
     -  Q  N  Q  N  L  H  L  K  N  Q  L  I  S  L  L  V  I  *  N  L
     -   R  T  R  T  Y  T  *  R  T  S  *  S  V  Y  W  L  F  K  T  Y
3301 - ACTGACAATGTTGCCATTAAATGTGTTGACATCGTTAAGGAGGCACAAAGTGCTAATCCT - 3360
     - T  D  N  V  A  I  K  C  V  D  I  V  K  E  A  Q  S  A  N  P
     -  L  T  M  L  P  L  N  V  L  T  S  L  R  R  H  K  V  L  I  L
     -   *  Q  C  C  H  *  M  C  *  H  R  *  G  G  T  K  C  *  S  Y
```

FIG. 11 Con't

```
3361 - ATGGTGATTGTAAATGCTGCTAACATACACCTGAAACATGGTGGTGGTGTAGCAGGTGCA - 3420
      - M  V  I  V  N  A  A  N  I  H  L  K  H  G  G  G  V  A  G  A
      -  W  *  L  *  M  L  L  T  Y  T  *  N  M  V  V  V  *  Q  V  H
      -   G  D  C  K  C  C  *  H  T  P  E  T  W  W  W  C  S  R  C  T
3421 - CTCAACAAGGCAACCAATGGTGCCATGCAAAAGGAGAGTGATGATTACATTAAGCTAAAT - 3480
      - L  N  K  A  T  N  G  A  M  Q  K  E  S  D  D  Y  I  K  L  N
      -  S  T  R  Q  P  M  V  P  C  K  R  R  V  M  I  T  L  S  *  M
      -   Q  Q  G  N  Q  W  C  H  A  K  G  E  *  *  L  H  *  A  K  W
3481 - GGCCCTCTTACAGTAGGAGGGTCTTGTTTGCTTTCTGGACATAATCTTGCTAAGAAGTGT - 3540
      - G  P  L  T  V  G  G  S  C  L  L  S  G  H  N  L  A  K  K  C
      -  A  L  L  Q  *  E  G  L  V  C  F  L  D  I  I  L  L  R  S  V
      -   P  S  Y  S  R  R  V  L  F  A  F  W  T  *  S  C  *  E  V  S
3541 - CTGCATGTTGTTGGACCTAACCTAAATGCAGGTGAGGACATCCAGCTTCTTAAGGCAGCA - 3600
      - L  H  V  V  G  P  N  L  N  A  G  E  D  I  Q  L  L  K  A  A
      -  C  M  L  L  D  L  T  *  M  Q  V  R  T  S  S  F  L  R  Q  H
      -   A  C  C  W  T  *  P  K  C  R  *  G  H  P  A  S  *  G  S  I
3601 - TATGAAAATTTCAATTCACAGGACATCTTACTTGCACCATTGTTGTCAGCAGGCATATTT - 3660
      - Y  E  N  F  N  S  Q  D  I  L  L  A  P  L  L  S  A  G  I  F
      -  M  K  I  S  I  H  R  T  S  Y  L  H  H  C  C  Q  Q  A  Y  L
      -   *  K  F  Q  F  T  G  H  L  T  C  T  I  V  V  S  R  H  I  W
3661 - GGTGCTAAACCACTTCAGTCTTTACAAGTGTGCGTGCAGACGGTTCGTACACAGGTTTAT - 3720
      - G  A  K  P  L  Q  S  L  Q  V  C  V  Q  T  V  R  T  Q  V  Y
      -  V  L  N  H  F  S  L  Y  K  C  A  C  R  R  F  V  H  R  F  I
      -   C  *  T  T  S  V  F  T  S  V  R  A  D  G  S  Y  T  G  L  Y
3721 - ATTGCAGTCAATGACAAAGCTCTTTATGAGCAGGTTGTCATGGATTATCTTGATAACCTG - 3780
      - I  A  V  N  D  K  A  L  Y  E  Q  V  V  M  D  Y  L  D  N  L
      -  L  Q  S  M  T  K  L  F  M  S  R  L  S  W  I  I  L  I  T  *
      -   C  S  Q  *  Q  S  S  L  *  A  G  C  H  G  L  S  *  *  P  E
3781 - AAGCCTAGAGTGGAAGCACCTAAACAAGAGGAGCCACCAAACACAGAAGATTCCAAAACT - 3840
      - K  P  R  V  E  A  P  K  Q  E  E  P  P  N  T  E  D  S  K  T
      -  S  L  E  W  K  H  L  N  K  R  S  H  Q  T  Q  K  I  P  K  L
      -   A  *  S  G  S  T  *  T  R  G  A  T  K  H  R  R  F  Q  N  *
3841 - GAGGAGAAATCTGTCGTACAGAAGCCTGTCGATGTGAAGCCAAAAATTAAGGCCTGCATT - 3900
      - E  E  K  S  V  V  Q  K  P  V  D  V  K  P  K  I  K  A  C  I
      -  R  R  N  L  S  Y  R  S  L  S  M  *  S  Q  K  L  R  P  A  L
      -   G  E  I  C  R  T  E  A  C  R  C  E  A  K  N  *  G  L  H  *
3901 - GATGAGGTTACCACAACACTGGAAGAAACTAAGTTTCTTACCAATAAGTTACTCTTGTTT - 3960
      - D  E  V  T  T  T  L  E  E  T  K  F  L  T  N  K  L  L  L  F
      -  M  R  L  P  Q  H  W  K  K  L  S  F  L  P  I  S  Y  S  C  L
      -   *  G  Y  H  N  T  G  R  N  *  V  S  Y  Q  *  V  T  L  V  C
3961 - GCTGATATCAATGGTAAGCTTTACCATGATTCTCAGAACATGCTTAGAGGTGAAGATATG - 4020
      - A  D  I  N  G  K  L  Y  H  D  S  Q  N  M  L  R  G  E  D  M
      -  L  I  S  M  V  S  F  T  M  I  L  R  T  C  L  E  V  K  I  C
      -   *  Y  Q  W  *  A  L  P  *  F  S  E  H  A  *  R  *  R  Y  V
4021 - TCTTTCCTTGAGAAGGATGCACCTTACATGGTAGGTGATGTTATCACTAGTGGTGATATC - 4080
      - S  F  L  E  K  D  A  P  Y  M  V  G  D  V  I  T  S  G  D  I
      -  L  S  L  R  R  M  H  L  T  W  *  V  M  L  S  L  V  V  I  S
      -   F  P  *  E  G  C  T  L  H  G  R  *  C  Y  H  *  W  *  Y  H
4081 - ACTTGTGTTGTAATACCCTCCAAAAAGGCTGGTGGCACTACTGAGATGCTCTCAAGAGCT - 4140
      - T  C  V  V  I  P  S  K  K  A  G  G  T  T  E  M  L  S  R  A
      -  L  V  L  *  Y  P  P  K  R  L  V  A  L  L  R  C  S  Q  E  L
      -   L  C  C  N  T  L  Q  K  G  W  W  H  Y  *  D  A  L  K  S  F
4141 - TTGAAGAAAGTGCCAGTTGATGAGTATATAACCACGTACCCTGGACAAGGATGTGCTGGT - 4200
      - L  K  K  V  P  V  D  E  Y  I  T  T  Y  P  G  Q  G  C  A  G
      -  *  R  K  C  Q  L  M  S  I  *  P  R  T  L  D  K  D  V  L  V
      -   E  E  S  A  S  *  *  V  Y  N  H  V  P  W  T  R  M  C  W  L
```

FIG. 11 Con't

```
4201 - TATACACTTGAGGAAGCTAAGACTGCTCTTAAGAAATGCAAATCTGCATTTTATGTACTA - 4260
     - Y  T  L  E  E  A  K  T  A  L  K  K  C  K  S  A  F  Y  V  L
     -  I  H  L  R  K  L  R  L  L  L  R  N  A  N  L  H  F  M  Y  Y
     -   Y  T  *  G  S  *  D  C  S  *  E  M  Q  I  C  I  L  C  T  T
4261 - CCTTCAGAAGCACCTAATGCTAAGGAAGAGATTCTAGGAACTGTATCCTGGAATTTGAGA - 4320
     - P  S  E  A  P  N  A  K  E  E  I  L  G  T  V  S  W  N  L  R
     -  L  Q  K  H  L  M  L  R  K  R  F  *  E  L  Y  P  G  I  *  E
     -   F  R  S  T  *  C  *  G  R  D  S  R  N  C  I  L  E  F  E  R
4321 - GAAATGCTTGCTCATGCTGAAGAGACAAGAAAATTAATGCCTATATGCATGGATGTTAGA - 4380
     - E  M  L  A  H  A  E  E  T  R  K  L  M  P  I  C  M  D  V  R
     -  K  C  L  L  M  L  K  R  Q  E  N  *  C  L  Y  A  W  M  L  E
     -   N  A  C  S  C  *  R  D  K  K  I  N  A  Y  M  H  G  C  *  S
4381 - GCCATAATGGCAACCATCCAACGTAAGTATAAAGGAATTAAAATTCAAGAGGGCATCGTT - 4440
     - A  I  M  A  T  I  Q  R  K  Y  K  G  I  K  I  Q  E  G  I  V
     -  P  *  W  Q  P  S  N  V  S  I  K  E  L  K  F  K  R  A  S  L
     -   H  N  G  N  H  P  T  *  V  *  R  N  *  N  S  R  G  H  R  *
4441 - GACTATGGTGTCCGATTCTTCTTTTATACTAGTAAAGAGCCTGTAGCTTCTATTATTACG - 4500
     - D  Y  G  V  R  F  F  F  Y  T  S  K  E  P  V  A  S  I  I  T
     -  T  M  V  S  D  S  S  F  I  L  V  K  S  L  *  L  L  L  R
     -   L  W  C  P  I  L  L  L  Y  *  *  R  A  C  S  F  Y  Y  Y  E
4501 - AAGCTGAACTCTCTAAATGAGCCGCTTGTCACAATGCCAATTGGTTATGTGACACATGGT - 4560
     - K  L  N  S  L  N  E  P  L  V  T  M  P  I  G  Y  V  T  H  G
     -  S  *  T  L  *  M  S  R  L  S  Q  C  Q  L  V  M  *  H  M  V
     -   A  E  L  S  K  *  A  A  C  H  N  A  N  W  L  C  D  T  W  F
4561 - TTTAATCTTGAAGAGGCTGCGCGCTGTATGCGTTCTCTTAAAGCTCCTGCCGTAGTGTCA - 4620
     - F  N  L  E  E  A  A  R  C  M  R  S  L  K  A  P  A  V  V  S
     -  L  I  L  K  R  L  R  A  V  C  V  L  L  K  L  L  P  *  C  Q
     -   *  S  *  R  G  C  A  L  Y  A  F  S  *  S  S  C  R  S  V  S
4621 - GTATCATCACCAGATGCTGTTACTACATATAATGGATACCTCACTTCGTCATCAAAGACA - 4680
     - V  S  S  P  D  A  V  T  T  Y  N  G  Y  L  T  S  S  S  K  T
     -  Y  H  H  Q  M  L  L  L  H  I  M  D  T  S  L  R  H  Q  R  H
     -   I  I  T  R  C  C  Y  Y  I  *  W  I  P  H  F  V  I  K  D  I
4681 - TCTGAGGAGCACTTTGTAGAAACAGTTTCTTTGGCTGGCTCTTACAGAGATTGGTCCTAT - 4740
     - S  E  E  H  F  V  E  T  V  S  L  A  G  S  Y  R  D  W  S  Y
     -  L  R  S  T  L  *  K  Q  F  L  W  L  A  L  T  E  I  G  P  I
     -   *  G  A  L  C  R  N  S  F  F  G  W  L  L  Q  R  L  V  L  F
4741 - TCAGGACAGCGTACAGAGTTAGGTGTTGAATTTCTTAAGCGTGGTGACAAAATTGTGTAC - 4800
     - S  G  Q  R  T  E  L  G  V  E  F  L  K  R  G  D  K  I  V  Y
     -  Q  D  S  V  Q  S  *  V  L  N  F  L  S  V  V  T  K  L  C  T
     -   R  T  A  Y  R  V  R  C  *  I  S  *  A  W  *  Q  N  C  V  P
4801 - CACACTCTGGAGAGCCCCGTCGAGTTTCATCTTGACGGTGAGGTTCTTTCACTTGACAAA - 4860
     - H  T  L  E  S  P  V  E  F  H  L  D  G  E  V  L  S  L  D  K
     -  T  L  W  R  A  P  S  S  F  I  L  T  V  R  F  F  H  L  T  N
     -   H  S  G  E  P  R  R  V  S  S  *  R  *  G  S  F  T  *  Q  T
4861 - CTAAAGAGTCTCTTATCCCTGCGGGAGGTTAAGACTATAAAAGTGTTCACAACTGTGGAC - 4920
     - L  K  S  L  L  S  L  R  E  V  K  T  I  K  V  F  T  T  V  D
     -  *  R  V  S  Y  P  C  G  R  L  R  L  *  K  C  S  Q  L  W  T
     -   K  E  S  L  I  P  A  G  G  *  D  Y  K  S  V  H  N  C  G  Q
4921 - AACACTAATCTCCACACACAGCTTGTGGATATGTCTATGACATATGGACAGCAGTTTGGT - 4980
     - N  T  N  L  H  T  Q  L  V  D  M  S  M  T  Y  G  Q  Q  F  G
     -  T  L  I  S  T  H  S  L  W  I  C  L  *  H  M  D  S  S  L  V
     -   H  *  S  P  H  T  A  C  G  Y  V  V  Y  D  I  W  T  A  V  W  S
4981 - CCAACATACTTGGATGGTGCTGATGTTACAAAAATTAAACCTCATGTAAATCATGAGGGT - 5040
     - P  T  Y  L  D  G  A  D  V  T  K  I  K  P  H  V  N  H  E  G
     -  Q  H  T  W  M  V  L  M  L  Q  K  L  N  L  M  *  I  M  R  V
     -   N  I  L  G  W  C  *  C  Y  K  N  *  T  S  C  K  S  *  G  *
```

FIG. 11 Con't

```
5041 - AAGACTTTCTTTGTACTACCTAGTGATGACACACTACGTAGTGAAGCTTTCGAGTACTAC - 5100
     -  K  T  F  F  V  L  P  S  D  D  T  L  R  S  E  A  F  E  Y  Y
     -   R  L  S  L  Y  Y  L  V  M  T  H  Y  V  V  K  L  S  S  T  T
     -    D  F  L  C  T  T  *  *  *  H  T  T  *  *  S  F  R  V  L  P
5101 - CATACTCTTGATGAGAGTTTTCTTGGTAGGTACATGTCTGCTTTAAACCACACAAAGAAA - 5160
     -  H  T  L  D  E  S  F  L  G  R  Y  M  S  A  L  N  H  T  K  K
     -   I  L  L  M  R  V  F  L  V  G  T  C  L  L  *  T  T  Q  R  N
     -    Y  S  *  *  E  F  S  W  *  V  H  V  C  F  K  P  H  K  E  M
5161 - TGGAAATTTCCTCAAGTTGGTGGTTTAACTTCAATTAAATGGGCTGATAACAATTGTTAT - 5220
     -  W  K  F  P  Q  V  G  G  L  T  S  I  K  W  A  D  N  N  C  Y
     -   G  N  F  L  K  L  V  V  *  L  Q  L  N  G  L  I  T  I  V  I
     -    E  I  S  S  S  W  W  F  N  F  N  *  M  G  *  *  Q  L  L  F
5221 - TTGTCTAGTGTTTTATTAGCACTTCAACAGCTTGAAGTCAAATTCAATGCACCAGCACTT - 5280
     -  L  S  S  V  L  L  A  L  Q  Q  L  E  V  K  F  N  A  P  A  L
     -   C  L  V  F  Y  *  H  F  N  S  L  K  S  N  S  M  H  Q  H  F
     -    V  *  C  F  I  S  T  S  T  A  *  S  Q  I  Q  C  T  S  T  S
5281 - CAAGAGGCTTATTATAGAGCCCGTGCTGGTGATGCTGCTAACTTTTGTGCACTCATACTC - 5340
     -  Q  E  A  Y  Y  R  A  R  A  G  D  A  A  N  F  C  A  L  I  L
     -   K  R  L  I  I  E  P  V  L  V  M  L  L  T  F  V  H  S  Y  S
     -    R  G  L  L  *  S  P  C  W  *  C  C  *  L  L  C  T  H  T  R
5341 - GCTTACAGTAATAAAACTGTTGGCGAGCTTGGTGATGTCAGAGAAACTATGACCCATCTT - 5400
     -  A  Y  S  N  K  T  V  G  E  L  G  D  V  R  E  T  M  T  H  L
     -   L  T  V  I  K  L  L  A  S  L  V  M  S  E  K  L  *  P  I  F
     -    L  Q  *  *  N  C  W  R  A  W  *  C  Q  R  N  Y  D  P  S  S
5401 - CTACAGCATGCTAATTTGGAATCTGCAAAGCGAGTTCTTAATGTGGTGTGTAAACATTGT - 5460
     -  L  Q  H  A  N  L  E  S  A  K  R  V  L  N  V  V  C  K  H  C
     -   Y  S  M  L  I  W  N  L  Q  S  E  F  L  M  W  C  V  N  I  V
     -    T  A  C  *  F  G  I  C  K  A  S  S  *  C  G  V  *  T  L  W
5461 - GGTCAGAAAACTACTACCTTAACGGGTGTAGAAGCTGTGATGTATATGGGTACTCTATCT - 5520
     -  G  Q  K  T  T  T  L  T  G  V  E  A  V  M  Y  M  G  T  L  S
     -   V  R  K  L  L  P  *  R  V  *  K  L  *  C  I  W  V  L  Y  L
     -    S  E  N  Y  Y  L  N  G  C  R  S  C  D  V  Y  G  Y  S  I  L
5521 - TATGATAATCTTAAGACAGGTGTTTCCATTCCATGTGTGTGTGGTCGTGATGCTACACAA - 5580
     -  Y  D  N  L  K  T  G  V  S  I  P  C  V  C  G  R  D  A  T  Q
     -   M  I  I  L  R  Q  V  F  P  P  F  H  V  C  V  V  V  M  L  H  N
     -    *  *  S  *  D  R  C  F  H  S  M  C  V  W  S  *  C  Y  T  I
5581 - TATCTAGTACAACAAGAGTCTTCTTTTGTTATGATGTCTGCACCACCTGCTGAGTATAAA - 5640
     -  Y  L  V  Q  Q  E  S  S  F  V  M  M  S  A  P  P  A  E  Y  K
     -   I  *  Y  N  K  S  L  L  L  L  *  C  L  H  H  L  L  S  I  N
     -    S  S  T  T  R  V  F  F  C  Y  D  V  C  T  T  C  *  V  *  I
5641 - TTACAGCAAGGTACATTCTTATGTGCGAATGAGTACACTGGTAACTATCAGTGTGGTCAT - 5700
     -  L  Q  Q  G  T  F  L  C  A  N  E  Y  T  G  N  Y  Q  C  G  H
     -   Y  S  K  V  H  S  Y  V  R  M  S  T  L  V  T  I  S  V  V  I
     -    T  A  R  Y  I  L  M  C  E  *  V  H  W  *  L  S  V  W  S  L
5701 - TACACTCATATAACTGCTAAGGAGACCCTCTATCGTATTGACGGAGCTCACCTTACAAAG - 5760
     -  Y  T  H  I  T  A  K  E  T  L  Y  R  I  D  G  A  H  L  T  K
     -   T  L  I  *  L  L  R  R  P  S  I  V  L  T  E  L  T  L  Q  R
     -    H  S  Y  N  C  *  G  D  P  L  S  Y  *  R  S  S  P  Y  K  D
5761 - ATGTCAGAGTACAAAGGACCAGTGACTGATGTTTTCTACAAGGAAACATCTTACACTACA - 5820
     -  M  S  E  Y  K  G  P  V  T  D  V  F  Y  K  E  T  S  Y  T  T
     -   C  Q  S  T  K  D  Q  *  L  M  F  S  T  R  K  H  L  T  L  Q
     -    V  R  V  Q  R  T  S  D  *  C  F  L  Q  G  N  I  L  H  Y  N
5821 - ACCATCAAGCCTGTGTCGTATAAACTCGATGGAGTTACTTACACAGAGATTGAACCAAAA - 5880
     -  T  I  K  P  V  S  Y  K  L  D  G  V  T  Y  T  E  I  E  P  K
     -   P  S  S  L  C  R  I  N  S  M  E  L  L  T  Q  R  L  N  Q  N
     -    H  Q  A  C  V  V  *  T  R  W  S  Y  L  H  R  D  *  T  K  I
```

FIG. 11 Con't

```
5881 - TTGGATGGGTATTATAAAAAGGATAATGCTTACTATACAGAGCAGCCTATAGACCTTGTA - 5940
     - L  D  G  Y  Y  K  K  D  N  A  Y  Y  T  E  Q  P  I  D  L  V
     - W  M  G  I  I  K  R  I  M  L  T  I  Q  S  S  L  *  T  L  Y
     -  G  W  V  L  *  K  G  *  C  L  L  Y  R  A  A  Y  R  P  C  T
5941 - CCAACTCAACCATTACCAAATGCGAGTTTTGATAATTTCAAACTCACATGTTCTAACACA - 6000
     - P  T  Q  P  L  P  N  A  S  F  D  N  F  K  L  T  C  S  N  T
     - Q  L  N  H  Y  Q  M  R  V  L  I  I  S  N  S  H  V  L  T  Q
     -  N  S  T  I  T  K  C  E  F  *  *  F  Q  T  H  M  F  *  H  K
6001 - AAATTTGCTGATGATTTAAATCAAATGACAGGCTTCACAAAGCCAGCTTCACGAGAGCTA - 6060
     - K  F  A  D  D  L  N  Q  M  T  G  F  T  K  P  A  S  R  E  L
     - N  L  L  M  I  *  I  K  *  Q  A  S  Q  S  Q  L  H  E  S  Y
     -  I  C  *  *  F  K  S  N  D  R  L  H  K  A  S  F  T  R  A  I
6061 - TCTGTCACATTCTTCCCAGACTTGAATGGCGATGTAGTGGCTATTGACTATAGACACTAT - 6120
     - S  V  T  F  F  P  D  L  N  G  D  V  V  A  I  D  Y  R  H  Y
     - L  S  H  S  S  Q  T  *  M  A  M  *  W  L  L  T  I  D  T  I
     -  C  H  I  L  P  R  L  E  W  R  C  S  G  Y  *  L  *  T  L  F
6121 - TCAGCGAGTTTCAAGAAAGGTGCTAAATTACTGCATAAGCCAATTGTTTGGCACATTAAC - 6180
     - S  A  S  F  K  K  G  A  K  L  L  H  K  P  I  V  W  H  I  N
     - Q  R  V  S  R  K  V  L  N  Y  C  I  S  Q  L  F  G  T  L  T
     -  S  E  F  Q  E  R  C  *  I  T  A  *  A  N  C  L  A  H  *  P
6181 - CAGGCTACAACCAAGACAACGTTCAAACCAAACACTTGGTGTTTACGTTGTCTTTGGAGT - 6240
     - Q  A  T  T  K  T  T  F  K  P  N  T  W  C  L  R  C  L  W  S
     - R  L  Q  P  R  Q  R  S  N  Q  T  L  G  V  Y  Y  V  F  G  V
     -  G  Y  N  Q  D  N  V  Q  T  K  H  L  V  F  T  L  S  L  E  Y
6241 - ACAAAGCCAGTAGATACTTCAAATTCATTTGAAGTTCTGGCAGTAGAAGACACACAAGGA - 6300
     - T  K  P  V  D  T  S  N  S  F  E  V  L  A  V  E  D  T  Q  G
     - Q  S  Q  *  I  L  Q  I  H  L  K  F  W  Q  *  K  T  H  K  E
     -  K  A  S  R  Y  F  K  F  I  *  S  S  G  S  R  R  H  T  R  N
6301 - ATGGACAATCTTGCTTGTGAAAGTCAACAACCCACCTCTGAAGAAGTAGTGGAAAATCCT - 6360
     - M  D  N  L  A  C  E  S  Q  Q  P  T  S  E  E  V  V  E  N  P
     - W  T  I  L  L  V  K  V  N  N  P  P  L  K  K  *  W  K  I  L
     -  G  Q  S  C  L  *  K  S  T  T  H  L  *  R  S  S  G  K  S  Y
6361 - ACCATACAGAAGGAAGTCATAGAGTGTGACGTGAAAACTACCGAAGTTGTAGGCAATGTC - 6420
     - T  I  Q  K  E  V  I  E  C  D  V  K  T  T  E  V  V  G  N  V
     - P  Y  R  R  K  S  *  S  V  T  *  K  L  P  K  L  *  A  M  S
     -  H  T  E  G  S  H  R  V  *  R  E  N  Y  R  S  C  R  Q  C  H
6421 - ATACTTAAACCATCAGATGAAGGTGTTAAAGTAACACAAGAGTTAGGTCATGAGGATCTT - 6480
     - I  L  K  P  S  D  E  G  V  K  V  T  Q  E  L  G  H  E  D  L
     - Y  L  N  H  Q  M  K  V  L  K  *  H  K  S  *  V  M  R  I  L
     -  T  *  T  I  R  *  R  C  *  S  N  T  R  V  R  S  *  G  S  Y
6481 - ATGGCTGCTTATGTGGAAAACACAAGCATTACCATTAAGAAACCTAATGAGCTTTCACTA - 6540
     - M  A  A  Y  V  E  N  T  S  I  T  I  K  K  P  N  E  L  S  L
     - W  L  L  M  W  K  T  Q  A  L  P  L  R  N  L  M  S  F  H  *
     -  G  C  L  C  G  K  H  K  H  Y  H  *  E  T  *  *  A  F  T  S
6541 - GCCTTAGGTTTAAAAACAATTGCCACTCATGGTATTGCTGCAATTAATAGTGTTCCTTGG - 6600
     - A  L  G  L  K  T  I  A  T  H  G  I  A  A  I  N  S  V  P  W
     - P  *  V  *  K  Q  L  P  L  M  V  L  L  Q  L  I  V  F  L  G
     -  L  R  F  K  N  N  C  H  S  W  Y  C  C  N  *  *  C  S  L  E
6601 - AGTAAAATTTTGGCTTATGTCAAACCATTCTTAGGACAAGCAGCAATTACAACATCAAAT - 6660
     - S  K  I  L  A  Y  V  K  P  F  L  G  Q  A  A  I  T  T  S  N
     - V  K  F  W  L  M  S  N  H  S  *  D  K  Q  Q  L  Q  H  Q  I
     -  *  N  F  G  L  C  Q  T  I  L  R  T  S  S  N  Y  N  I  K  L
6661 - TGCGCTAAGAGATTAGCACAACGTGTGTTTAACAATTATATGCCTTATGTGTTTACATTA - 6720
     - C  A  K  R  L  A  Q  R  V  F  N  N  Y  M  P  Y  V  F  T  L
     - A  L  R  D  *  H  N  V  C  L  T  I  I  C  L  M  C  L  H  Y
     -  R  *  E  I  S  T  T  C  V  *  Q  L  Y  A  L  C  V  Y  I  I
```

FIG. 11 Con't

```
6721 - TTGTTCCAATTGTGTACTTTTACTAAAAGTACCAATTCTAGAATTAGAGCTTCACTACCT - 6780
      - L  F  Q  L  C  T  F  T  K  S  T  N  S  R  I  R  A  S  L  P
      -  C  S  N  C  V  L  L  L  K  V  P  I  L  E  L  E  L  H  Y  L
      -   V  P  I  V  Y  F  Y  *  K  Y  Q  F  *  N  *  S  F  T  T  Y
6781 - ACAACTATTGCTAAAAATAGTGTTAAGAGTGTTGCTAAATTATGTTTGGATGCCGGCATT - 6840
      - T  T  I  A  K  N  S  V  K  S  V  A  K  L  C  L  D  A  G  I
      -  Q  L  L  L  K  I  V  L  R  V  L  L  N  Y  V  W  M  P  A  L
      -   N  Y  C  *  K  *  C  *  E  C  C  *  I  M  F  G  C  R  H  *
6841 - AATTATGTGAAGTCACCCAAATTTTCTAAATTGTTCACAATCGCTATGTGGCTATTGTTG - 6900
      - N  Y  V  K  S  P  K  F  S  K  L  F  T  I  A  M  W  L  L  L
      -  I  M  *  S  H  P  N  F  L  N  C  S  Q  S  L  C  G  Y  C  C
      -   L  C  E  V  T  Q  I  F  *  I  V  H  N  R  Y  V  A  I  V  V
6901 - TTAAGTATTTGCTTAGGTTCTCTAATCTGTGTAACTGCTGCTTTTGGTGTACTCTTATCT - 6960
      - L  S  I  C  L  G  S  L  I  C  V  T  A  A  F  G  V  L  L  S
      -  *  V  F  A  *  V  L  *  S  V  *  L  L  L  L  V  Y  S  Y  L
      -   K  Y  L  L  R  F  S  N  L  C  N  C  C  F  W  C  T  L  I  *
6961 - AATTTTGGTGCTCCTTCTTATTGTAATGGCGTTAGAGAATTGTATCTTAATTCGTCTAAC - 7020
      - N  F  G  A  P  S  Y  C  N  G  V  R  E  L  Y  L  N  S  S  N
      -  I  L  V  L  L  L  I  V  M  A  L  E  N  C  I  L  I  R  L  T
      -   F  W  C  S  F  L  L  *  W  R  *  R  I  V  S  *  F  V  *  R
7021 - GTTACTACTATGGATTTCTGTGAAGGTTCTTTTCCTTGCAGCATTTGTTTAAGTGGATTA - 7080
      - V  T  T  M  D  F  C  E  G  S  F  P  C  S  I  C  L  S  G  L
      -  L  L  L  W  I  S  V  K  V  L  F  L  A  A  F  V  *  V  D  *
      -   Y  Y  Y  G  F  L  *  R  F  F  S  L  Q  H  L  F  K  W  I  R
7081 - GACTCCCTTGATTCTTATCCAGCTCTTGAAACCATTCAGGTGACGATTTCATCGTACAAG - 7140
      - D  S  L  D  S  Y  P  A  L  E  T  I  Q  V  T  I  S  S  Y  K
      -  T  P  L  I  L  I  Q  L  L  K  P  F  R  *  R  F  H  R  T  S
      -   L  P  *  F  L  S  S  S  *  N  H  S  G  D  D  F  I  V  Q  A
7141 - CTAGACTTGACAATTTTAGGTCTGGCCGCTGAGTGGGTTTTGGCATATATGTTGTTCACA - 7200
      - L  D  L  T  I  L  G  L  A  A  E  W  V  L  A  Y  M  L  F  T
      -  *  T  *  Q  F  *  V  W  P  L  S  G  F  W  H  I  C  C  S  Q
      -   R  L  D  N  F  R  S  G  R  *  V  G  F  G  I  Y  V  V  H  K
7201 - AAATTCTTTTATTTATTAGGTCTTTCAGCTATAATGCAGGTGTTCTTTGGCTATTTTGCT - 7260
      - K  F  F  Y  L  L  G  L  S  A  I  M  Q  V  F  F  G  Y  F  A
      -  N  S  F  I  Y  *  V  F  Q  L  *  C  R  C  S  L  A  I  L  L
      -   I  L  L  F  I  R  S  F  S  Y  N  A  G  V  L  W  L  F  C  *
7261 - AGTCATTTCATCAGCAATTCTTGGCTCATGTGGTTTATCATTAGTATTGTACAAATGGCA - 7320
      - S  H  F  I  S  N  S  W  L  M  W  F  I  I  S  I  V  Q  M  A
      -  V  I  S  S  A  I  L  G  S  C  G  L  S  L  V  L  Y  K  W  H
      -   S  F  H  Q  Q  F  L  A  H  V  V  Y  H  *  Y  C  T  N  G  T
7321 - CCCGTTTCTGCAATGGTTAGGATGTACATCTTCTTTGCTTCTTTCTACTACATATGGAAG - 7380
      - P  V  S  A  M  V  R  M  Y  I  F  F  A  S  F  Y  Y  I  W  K
      -  P  F  L  Q  W  L  G  C  T  S  S  L  L  L  S  T  T  Y  G  R
      -   R  F  C  N  G  *  D  V  H  L  L  C  F  F  L  L  H  M  E  E
7381 - AGCTATGTTCATATCATGGATGGTTGCACCTCTTCGACTTGCATGATGTGCTATAAGCGC - 7440
      - S  Y  V  H  I  M  D  G  C  T  S  S  T  C  M  M  C  Y  K  R
      -  A  M  F  I  S  W  M  V  A  P  L  R  L  A  *  C  A  I  S  A
      -   L  C  S  Y  H  G  W  L  H  L  F  D  L  H  D  V  L  *  A  Q
7441 - AATCGTGCCACACGCGTTGAGTGTACAACTATTGTTAATGGCATGAAGAGATCTTTCTAT - 7500
      - N  R  A  T  R  V  E  C  T  T  I  V  N  G  M  K  R  S  F  Y
      -  I  V  P  H  A  L  S  V  Q  L  L  L  M  A  *  R  D  L  S  M
      -   S  C  H  T  R  *  V  Y  N  Y  C  *  W  H  E  E  I  F  L  C
7501 - GTCTATGCAAATGGAGGCCGTGGCTTCTGCAAGACTCACAATTGGAATTGTCTCAATTGT - 7560
      - V  Y  A  N  G  G  R  G  F  C  K  T  H  N  W  N  C  L  N  C
      -  S  M  Q  M  E  A  V  A  S  A  R  L  T  I  G  I  V  S  I  V
      -   L  C  K  W  R  P  W  L  L  Q  D  S  Q  L  E  L  S  Q  L  *
```

FIG. 11 Con't

```
7561 - GACACATTTTGCACTGGTAGTACATTCATTAGTGATGAAGTTGCTCGTGATTTGTCACTC - 7620
       - D  T  F  C  T  G  S  T  F  I  S  D  E  V  A  R  D  L  S  L
       -  T  H  F  A  L  V  V  H  S  L  V  M  K  L  L  V  I  C  H  S
       -   H  I  L  H  W  *  Y  I  H  *  *  *  S  C  S  *  F  V  T  P
7621 - CAGTTTAAAAGACCAATCAACCCTACTGACCAGTCATCGTATATTGTTGATAGTGTTGCT - 7680
       - Q  F  K  R  P  I  N  P  T  D  Q  S  S  Y  I  V  D  S  V  A
       -  S  L  K  D  Q  S  T  L  L  T  S  H  R  I  L  L  I  V  L  L
       -   V  *  K  T  N  Q  P  Y  *  P  V  I  V  Y  C  *  *  C  C  C
7681 - GTGAAAAATGGCGCGCTTCACCTCTACTTTGACAAGGCTGGTCAAAAGACCTATGAGAGA - 7740
       - V  K  N  G  A  L  H  L  Y  F  D  K  A  G  Q  K  T  Y  E  R
       -  *  K  M  A  R  F  T  S  T  L  T  R  L  V  K  R  P  M  R  D
       -   E  K  W  R  A  S  P  L  L  *  Q  G  W  S  K  D  L  *  E  T
7741 - CATCCGCTCTCCCATTTTGTCAATTTAGACAATTTGAGAGCTAACAACACTAAAGGTTCA - 7800
       - H  P  L  S  H  F  V  N  L  D  N  L  R  A  N  N  T  K  G  S
       -  I  R  S  P  I  L  S  I  *  T  I  *  E  L  T  T  L  K  V  H
       -   S  A  L  P  F  C  Q  F  R  Q  F  E  S  *  Q  H  *  R  F  T
7801 - CTGCCTATTAATGTCATAGTTTTTGATGGCAAGTCCAAATGCGACGAGTCTGCTTCTAAG - 7860
       - L  P  I  N  V  I  V  F  D  G  K  S  K  C  D  E  S  A  S  K
       -  C  L  L  M  S  *  F  L  M  A  S  P  N  A  T  S  L  L  L  S
       -   A  Y  *  C  H  S  F  *  W  Q  V  Q  M  R  R  V  C  F  *  V
7861 - TCTGCTTCTGTGTACTACAGTCAGCTGATGTGCCAACCTATTCTGTTGCTTGACCAAGCT - 7920
       - S  A  S  V  Y  Y  S  Q  L  M  C  Q  P  I  L  L  L  D  Q  A
       -  L  L  L  C  T  T  V  S  *  C  A  N  L  F  C  C  L  T  K  L
       -   C  F  C  V  L  Q  S  A  D  V  P  T  Y  S  V  A  *  P  S  S
7921 - CTTGTATCAAACGTTGGAGATAGTACTGAAGTTTCCGTTAAGATGTTTGATGCTTATGTC - 7980
       - L  V  S  N  V  G  D  S  T  E  V  S  V  K  M  F  D  A  Y  V
       -  L  Y  Q  T  L  E  I  V  L  K  F  P  L  R  C  L  M  L  M  S
       -   C  I  K  R  W  R  *  Y  *  S  F  R  *  D  V  *  C  L  C  R
7981 - GACACCTTTTCAGCAACTTTTAGTGTTCCTATGGAAAAACTTAAGGCACTTGTTGCTACA - 8040
       - D  T  F  S  A  T  F  S  V  P  M  E  K  L  K  A  L  V  A  T
       -  T  P  F  Q  Q  L  L  V  F  L  W  K  N  L  R  H  L  L  L  Q
       -   H  L  F  S  N  F  *  C  S  Y  G  K  T  *  G  T  C  C  Y  S
8041 - GCTCACAGCGAGTTAGCAAAGGGTGTAGCTTTAGATGGTGTCCTTTCTACATTCGTGTCA - 8100
       - A  H  S  E  L  A  K  G  V  A  L  D  G  V  L  S  T  F  V  S
       -  L  T  A  S  *  Q  R  V  *  L  *  M  V  S  F  L  H  S  C  Q
       -   S  Q  R  V  S  K  G  C  S  F  R  W  C  P  F  Y  I  R  V  S
8101 - GCTGCCCGACAAGGTGTTGTTGATACCGATGTTGACACAAAGGATGTTATTGAATGTCTC - 8160
       - A  A  R  Q  G  V  V  D  T  D  V  D  T  K  D  V  I  E  C  L
       -  L  P  D  K  V  L  L  I  P  M  L  T  Q  R  M  L  L  N  V  S
       -   C  P  T  R  C  C  *  Y  R  C  *  H  K  G  C  Y  *  M  S  Q
8161 - AAACTTTCACATCACTCTGACTTAGAAGTGACAGGTGACAGTTGTAACAATTTCATGCTC - 8220
       - K  L  S  H  H  S  D  L  E  V  T  G  D  S  C  N  N  F  M  L
       -  N  F  H  I  T  L  T  *  K  *  Q  V  T  V  V  T  I  S  C  S
       -   T  F  T  S  L  *  L  R  S  D  R  *  Q  L  *  Q  F  H  A  H
8221 - ACCTATAATAAGGTTGAAAACATGACGCCCAGAGATCTTGGCGCATGTATTGACTGTAAT - 8280
       - T  Y  N  K  V  E  N  M  T  P  R  D  L  G  A  C  I  D  C  N
       -  P  I  I  R  L  K  T  *  R  P  E  I  L  A  H  V  L  T  V  M
       -   L  *  *  G  *  K  H  D  A  Q  R  S  W  R  M  Y  *  L  *  C
8281 - GCAAGGCATATCAATGCCCAAGTAGCAAAAAGTCACAATGTTTCACTCATCTGGAATGTA - 8340
       - A  R  H  I  N  A  Q  V  A  K  S  H  N  V  S  L  I  W  N  V
       -  Q  G  I  S  M  P  K  *  Q  K  V  T  M  F  H  S  S  G  M  *
       -   K  A  Y  Q  C  P  S  S  K  K  S  Q  C  F  T  H  L  E  C  K
8341 - AAAGACTACATGTCTTTATCTGAACAGCTGCGTAAACAAATTCGTACTGCTGCCAAGAAG - 8400
       - K  D  Y  M  S  L  S  E  Q  L  R  K  Q  I  R  T  A  A  K  K
       -  K  T  T  C  L  Y  L  N  S  C  V  N  K  F  V  L  L  P  R  R
       -   R  L  H  V  F  I  *  T  A  A  *  T  N  S  Y  C  C  Q  E  E
```

FIG. 11 Con't

```
8401 - AACAACATACCTTTTACACTAACTTGTGCTACAACTAGACAGGTTGTCAATGTCATAACT - 8460
     - N  N  I  P  F  T  L  T  C  A  T  T  R  Q  V  V  N  V  I  T
     -  T  T  Y  L  L  H  *  L  V  L  Q  L  D  R  L  S  M  S  *  L
     -   Q  H  T  F  Y  T  N  L  C  Y  N  *  T  G  C  Q  C  H  N  Y
8461 - ACTAAAATCTCACTCAAGGGTGGTAAGATTGTTAGTACTTGTTTTAAACTTATGCTTAAG - 8520
     - T  K  I  S  L  K  G  G  K  I  V  S  T  C  F  K  L  M  L  K
     -  L  K  S  H  S  R  V  V  R  L  L  V  L  V  L  N  L  C  L  R
     -   *  N  L  T  Q  G  W  *  D  C  *  Y  L  F  *  T  Y  A  *  G
8521 - GCCACATTATTGTGCGTTCTTGCTGCATTGGTTTGTTATATCGTTATGCCAGTACATACA - 8580
     - A  T  L  L  C  V  L  A  A  L  V  C  Y  I  V  M  P  V  H  T
     -  P  H  Y  C  A  F  L  L  H  W  F  V  I  S  L  C  Q  Y  I  H
     -   H  I  I  V  R  S  C  C  I  G  L  L  Y  R  Y  A  S  T  Y  I
8581 - TTGTCAATCCATGATGGTTACACAAATGAAATCATTGGTTACAAAGCCATTCAGGATGGT - 8640
     - L  S  I  H  D  G  Y  T  N  E  I  I  G  Y  K  A  I  Q  D  G
     -  C  Q  S  M  M  V  T  Q  M  K  S  L  V  T  K  P  F  R  M  V
     -   V  N  P  *  W  L  H  K  *  N  H  W  L  Q  S  H  S  G  W  C
8641 - GTCACTCGTGACATCATTTCTACTGATGATTGTTTTGCAAATAAACATGCTGGTTTTGAC - 8700
     - V  T  R  D  I  I  S  T  D  D  C  F  A  N  K  H  A  G  F  D
     -  S  L  V  T  S  F  L  L  M  I  V  L  Q  I  N  M  L  V  L  T
     -   H  S  *  H  H  F  Y  *  *  L  F  C  K  *  T  C  W  F  *  R
8701 - GCATGGTTTAGCCAGCGTGGTGGTTCATACAAAAATGACAAAAGCTGCCCTGTAGTAGCT - 8760
     - A  W  F  S  Q  R  G  G  S  Y  K  N  D  K  S  C  P  V  V  A
     -  H  G  L  A  S  V  V  V  H  T  K  M  T  K  A  A  L  *  *  L
     -   M  V  *  P  A  W  W  F  I  Q  K  *  Q  K  L  P  C  S  S  C
8761 - GCTATCATTACAAGAGAGATTGGTTTCATAGTGCCTGGCTTACCGGGTACTGTGCTGAGA - 8820
     - A  I  I  T  R  E  I  G  F  I  V  P  G  L  P  G  T  V  L  R
     -  L  S  L  Q  E  R  L  V  S  *  C  L  A  Y  R  V  L  C  *  E
     -   Y  H  Y  K  R  D  W  F  H  S  A  W  L  T  G  Y  C  A  E  S
8821 - GCAATCAATGGTGACTTCTTGCATTTTCTACCTCGTGTTTTTAGTGCTGTTGGCAACATT - 8880
     - A  I  N  G  D  F  L  H  F  L  P  R  V  F  S  A  V  G  N  I
     -  Q  S  M  V  T  S  C  I  F  Y  L  V  F  L  V  L  L  A  T  F
     -   N  Q  W  *  L  L  A  F  S  T  S  C  F  *  C  C  W  Q  H  L
8881 - TGCTACACACCTTCCAAACTCATTGAGTATAGTGATTTTGCTACCTCTGCTTGCGTTCTT - 8940
     - C  Y  T  P  S  K  L  I  E  Y  S  D  F  A  T  S  A  C  V  L
     -  A  T  H  L  P  N  S  L  S  I  V  I  L  L  P  L  L  A  F  L
     -   L  H  T  F  Q  T  H  *  V  *  *  F  C  Y  L  C  L  R  S  C
8941 - GCTGCTGAGTGTACAATTTTTAAGGATGCTATGGGCAAACCTGTGCCATATTGTTATGAC - 9000
     - A  A  E  C  T  I  F  K  D  A  M  G  K  P  V  P  Y  C  Y  D
     -  L  L  S  V  Q  F  L  R  M  L  W  A  N  L  C  H  I  V  M  T
     -   C  *  V  Y  N  F  *  G  C  Y  G  Q  T  C  A  I  L  L  *  H
9001 - ACTAATTTGCTAGAGGGTTCTATTTCTTATAGTGAGCTTCGTCCAGACACTCGTTATGTG - 9060
     - T  N  L  L  E  G  S  I  S  Y  S  E  L  R  P  D  T  R  Y  V
     -  L  I  C  *  R  V  L  F  L  I  V  S  F  V  Q  T  L  V  M  C
     -   *  F  A  R  G  F  Y  F  L  *  *  A  S  S  R  H  S  L  C  A
9061 - CTTATGGATGGTTCCATCATACAGTTTCCTAACACTTACCTGGAGGGTTCTGTTAGAGTA - 9120
     - L  M  D  G  S  I  I  Q  F  P  N  T  Y  L  E  G  S  V  R  V
     -  L  W  M  V  P  S  Y  S  F  L  T  L  T  W  R  V  L  L  E  *
     -   Y  G  W  F  H  H  T  V  S  *  H  L  P  G  G  F  C  *  S  S
9121 - GTAACAACTTTTGATGCTGAGTACTGTAGACATGGTACATGCGAAAGGTCAGAAGTAGGT - 9180
     - V  T  T  F  D  A  E  Y  C  R  H  G  T  C  E  R  S  E  V  G
     -  *  Q  L  L  M  L  S  T  V  D  M  V  H  A  K  G  Q  K  *  V
     -   N  N  F  *  C  *  V  L  *  T  W  Y  M  R  K  V  R  S  R  Y
9181 - ATTTGCCTATCTACCAGTGGTAGATGGGTTCTTAATAATGAGCATTACAGAGCTCTATCA - 9240
     - I  C  L  S  T  S  G  R  W  V  L  N  N  E  H  Y  R  A  L  S
     -  F  A  Y  L  P  V  V  D  G  F  L  I  M  S  I  T  E  L  Y  Q
     -   L  P  I  Y  Q  W  *  M  G  S  *  *  *  A  L  Q  S  S  I  R
```

FIG. 11 Con't

```
9241 - GGAGTTTTCTGTGGTGTTGATGCGATGAATCTCATAGCTAACATCTTTACTCCTCTTGTG - 9300
     -  G  V  F  C  G  V  D  A  M  N  L  I  A  N  I  F  T  P  L  V
     -  E  F  S  V  V  L  M  R  *  I  S  *  L  T  S  L  L  L  L  C
     -    S  F  L  W  C  *  C  D  E  S  H  S  *  H  L  Y  S  S  C  A
9301 - CAACCTGTGGGTGCTTTAGATGTGTCTGCTTCAGTAGTGGCTGGTGGTATTATTGCCATA - 9360
     -  Q  P  V  G  A  L  D  V  S  A  S  V  V  A  G  G  I  I  A  I
     -  N  L  W  V  L  *  M  C  L  L  Q  *  W  L  V  V  L  L  P  Y
     -    T  C  G  C  F  R  C  V  C  F  S  S  G  W  W  Y  Y  C  H  I
9361 - TTGGTGACTTGTGCTGCCTACTACTTTATGAAATTCAGACGTGTTTTTGGTGAGTACAAC - 9420
     -  L  V  T  C  A  A  Y  Y  F  M  K  F  R  R  V  F  G  E  Y  N
     -  W  *  L  V  L  P  T  T  L  *  N  S  D  V  F  L  V  S  T  T
     -    G  D  L  C  C  L  L  L  Y  E  I  Q  T  C  F  W  *  V  Q  P
9421 - CATGTTGTTGCTGCTAATGCACTTTTGTTTTGATGTCTTTCACTATACTCTGTCTGGTA - 9480
     -  H  V  V  A  A  N  A  L  L  F  L  M  S  F  T  I  L  C  L  V
     -  M  L  L  L  L  M  H  F  C  F  *  C  L  S  L  Y  S  V  W  Y
     -    C  C  C  C  *  C  T  F  V  F  D  V  F  H  Y  T  L  S  G  T
9481 - CCAGCTTACAGCTTTCTGCCGGGAGTCTACTCAGTCTTTTACTTGTACTTGACATTCTAT - 9540
     -  P  A  Y  S  F  L  P  G  V  Y  S  V  F  Y  L  Y  L  T  F  Y
     -  Q  L  T  A  F  C  R  E  S  T  Q  S  F  T  C  T  *  H  S  I
     -    S  L  Q  L  S  A  G  S  L  L  S  L  L  L  V  L  D  I  L  F
9541 - TTCACCAATGATGTTTCATTCTTGGCTCACCTTCAATGGTTTGCCATGTTTTCTCCTATT - 9600
     -  F  T  N  D  V  S  F  L  A  H  L  Q  W  F  A  M  F  S  P  I
     -  S  P  M  M  F  H  S  W  L  T  F  N  G  L  P  C  F  L  L  L
     -    H  Q  *  C  F  I  L  G  S  P  S  M  V  C  H  V  F  S  Y  C
9601 - GTGCCTTTTTGGATAACAGCAATCTATGTATTCTGTATTTCTCTGAAGCACTGCCATTGG - 9660
     -  V  P  F  W  I  T  A  I  Y  V  F  C  I  S  L  K  H  C  W
     -  C  L  F  G  *  Q  Q  S  M  Y  S  V  F  L  *  S  T  A  I  G
     -    A  F  L  D  N  S  N  L  C  I  L  Y  F  S  E  A  L  P  L  V
9661 - TTCTTTAACAACTATCTTAGGAAAAGAGTCATGTTTAATGGAGTTACATTTAGTACCTTC - 9720
     -  F  F  N  N  Y  L  R  K  R  V  M  F  N  G  V  T  F  S  T  F
     -  S  L  T  T  I  L  G  K  E  S  C  L  M  E  L  H  L  V  P  S
     -    L  *  Q  L  S  *  E  K  S  H  V  *  W  S  Y  I  *  Y  L  R
9721 - GAGGAGGCTGCTTTGTGTACCTTTTTGCTCAACAAGGAAATGTACCTAAAATTGCGTAGC - 9780
     -  E  E  A  A  L  C  T  F  L  L  N  K  E  M  Y  L  K  L  R  S
     -  R  R  L  L  C  V  P  F  C  S  T  R  K  C  T  *  N  C  V  A
     -    G  G  C  F  V  Y  L  F  A  Q  Q  G  N  V  P  K  I  A  *  R
9781 - GAGACACTGTTGCCACTTACACAGTATAACAGGTATCTTGCTCTATATAACAAGTACAAG - 9840
     -  E  T  L  L  P  L  T  Q  Y  N  R  Y  L  A  L  Y  N  K  Y  K
     -  R  H  C  C  H  L  H  S  I  T  G  I  L  L  Y  I  T  S  T  S
     -    D  T  V  A  T  Y  T  V  *  Q  V  S  C  S  I  *  Q  V  Q  V
9841 - TATTTCAGTGGAGCCTTAGATACTACCAGCTATCGTGAAGCAGCTTGCTGCCACTTAGCA - 9900
     -  Y  F  S  G  A  L  D  T  T  S  Y  R  E  A  A  C  C  H  L  A
     -  I  S  V  E  P  *  I  L  P  A  I  V  K  Q  L  A  A  T  *  Q
     -    F  Q  W  S  L  R  Y  Y  Q  L  S  *  S  S  L  L  P  L  S  K
9901 - AAGGCTCTAAATGACTTTAGCAACTCAGGTGCTGATGTTCTCTACCAACCACCACAGACA - 9960
     -  K  A  L  N  D  F  S  N  S  G  A  D  V  L  Y  Q  P  P  Q  T
     -  R  L  *  M  T  L  A  T  Q  V  L  M  F  S  T  N  H  H  R  H
     -    G  S  K  *  L  *  Q  L  R  C  *  C  S  L  P  T  T  T  D  I
9961 - TCAATCACTTCTGCTGTTCTGCAGAGTGGTTTTAGGAAAATGGCATTCCCGTCAGGCAAA - 10020
     -  S  I  T  S  A  V  L  Q  S  G  F  R  K  M  A  F  P  S  G  K
     -  Q  S  L  L  L  F  C  R  V  V  L  G  K  W  H  S  R  Q  A  K
     -    N  H  F  C  C  S  A  E  W  F  *  E  N  G  I  P  V  R  Q  S
10021 - GTTGAAGGGTGCATGGTACAAGTAACCTGTGGAACTACAACTCTTAATGGATTGTGGTTG - 10080
      -  V  E  G  C  M  V  Q  V  T  C  G  T  T  T  L  N  G  L  W  L
      -  L  K  G  A  W  Y  K  *  P  V  E  L  Q  L  L  M  D  C  G  W
      -    *  R  V  H  G  T  S  N  L  W  N  Y  N  S  *  W  I  V  V  G
```

FIG. 11 Con't

```
10081 - GATGACACAGTATACTGTCCAAGACATGTCATTTGCACAGCAGAAGACATGCTTAATCCT - 10140
       - D  D  T  V  Y  C  P  R  H  V  I  C  T  A  E  D  M  L  N  P
       - M  T  Q  Y  T  V  Q  D  M  S  F  A  Q  Q  K  T  C  L  I  L
       - *  H  S  I  L  S  K  T  C  H  L  H  S  R  R  H  A  *  S  *
10141 - AACTATGAAGATCTGCTCATTCGCAAATCCAACCATAGCTTTCTTGTTCAGGCTGGCAAT - 10200
       - N  Y  E  D  L  L  I  R  K  S  N  H  S  F  L  V  Q  A  G  N
       - T  M  K  I  C  S  F  A  N  P  T  I  A  F  L  F  R  L  A  M
       - L  *  R  S  A  H  S  Q  I  Q  P  *  L  S  C  S  G  W  Q  C
10201 - GTTCAACTTCGTGTTATTGGCCATTCTATGCAAAATTGTCTGCTTAGGCTTAAAGTTGAT - 10260
       - V  Q  L  R  V  I  G  H  S  M  Q  N  C  L  L  R  L  K  V  D
       - F  N  F  V  L  L  A  I  L  C  K  I  V  C  L  G  L  K  L  I
       - S  T  S  C  Y  W  P  F  Y  A  K  L  S  A  *  A  *  S  *  Y
10261 - ACTTCTAACCCTAAGACACCCAAGTATAAATTTGTCCGTATCCAACCTGGTCAAACATTT - 10320
       - T  S  N  P  K  T  P  K  Y  K  F  V  R  I  Q  P  G  Q  T  F
       - L  L  T  L  R  H  P  S  I  N  L  S  V  S  N  L  V  K  H  F
       - F  *  P  *  D  T  Q  V  *  I  C  P  Y  P  T  W  S  N  I  F
10321 - TCAGTTCTAGCATGCTACAATGGTTCACCATCTGGTGTTTATCAGTGTGCCATGAGACCT - 10380
       - S  V  L  A  C  Y  N  G  S  P  S  G  V  Y  Q  C  A  M  R  P
       - Q  F  *  H  A  T  M  V  H  H  L  V  F  I  S  V  P  *  D  L
       - S  S  S  M  L  Q  W  F  T  I  W  C  L  S  V  C  H  E  T  *
10381 - AATCATACCATTAAAGGTTCTTTCCTTAATGGATCATGTGGTAGTGTTGGTTTTAACATT - 10440
       - N  H  T  I  K  G  S  F  L  N  G  S  C  G  S  V  G  F  N  I
       - I  I  P  L  K  V  L  S  L  M  D  H  V  V  V  L  V  L  T  L
       - S  Y  H  *  R  F  F  P  *  W  I  M  W  *  C  W  F  *  H  *
10441 - GATTATGATTGCGTGTCTTTCTGCTATATGCATCATATGGAGCTTCCAACAGGAGTACAC - 10500
       - D  Y  D  C  V  S  F  C  Y  M  H  H  M  E  L  P  T  G  V  H
       - I  M  I  A  C  L  S  A  I  C  I  I  W  S  F  Q  Q  E  Y  T
       - L  *  L  R  V  F  L  L  Y  A  S  Y  G  A  S  N  R  S  T  R
10501 - GCTGGTACTGACTTAGAAGGTAAATTCTATGGTCCATTTGTTGACAGACAAACTGCACAG - 10560
       - A  G  T  D  L  E  G  K  F  Y  G  P  F  V  D  R  Q  T  A  Q
       - L  V  L  T  *  K  V  N  S  M  V  H  L  L  T  D  K  L  H  R
       - W  Y  *  L  R  R  *  I  L  W  S  I  C  *  Q  T  N  C  T  G
10561 - GCTGCAGGTACAGACACAACCATAACATTAAATGTTTTGGCATGGCTGTATGCTGCTGTT - 10620
       - A  A  G  T  D  T  T  I  T  L  N  V  L  A  W  L  Y  A  A  V
       - L  Q  V  Q  T  Q  P  *  H  *  M  F  W  H  G  C  M  L  L  L
       - C  R  Y  R  H  N  H  N  I  K  C  F  G  M  A  V  C  C  C  Y
10621 - ATCAATGGTGATAGGTGGTTTCTTAATAGATTCACCACTACTTTGAATGACTTTAACCTT - 10680
       - I  N  G  D  R  W  F  L  N  R  F  T  T  T  L  N  D  F  N  L
       - S  M  V  I  G  G  F  L  I  D  S  P  L  L  *  M  T  L  T  L
       - Q  W  *  *  V  V  S  *  *  I  H  H  Y  F  E  *  L  *  P  C
10681 - GTGGCAATGAAGTACAACTATGAACCTTTGACACAAGATCATGTTGACATATTGGGACCT - 10740
       - V  A  M  K  Y  N  Y  E  P  L  T  Q  D  H  V  D  I  L  G  P
       - W  Q  *  S  T  T  M  N  L  *  H  K  I  M  L  T  Y  W  D  L
       - G  N  E  V  Q  L  *  T  F  D  T  R  S  C  *  H  I  G  T  S
10741 - CTTTCTGCTCAAACAGGAATTGCCGTCTTAGATATGTGTGCTGCTTTGAAAGAGCTGCTG - 10800
       - L  S  A  Q  T  G  I  A  V  L  D  M  C  A  A  L  K  E  L  L
       - F  L  L  K  Q  E  L  P  S  *  I  C  V  L  L  *  K  S  C  C
       - F  C  S  N  R  N  C  R  L  R  Y  V  C  C  F  E  R  A  A  A
10801 - CAGAATGGTATGAATGGTCGTACTATCCTTGGTAGCACTATTTTAGAAGATGAGTTTACA - 10860
       - Q  N  G  M  N  G  R  T  I  L  G  S  T  I  L  E  D  E  F  T
       - R  M  V  *  M  V  V  L  S  L  V  A  L  F  *  K  M  S  L  H
       - E  W  Y  E  W  S  Y  Y  P  W  *  H  Y  F  R  R  *  V  Y  T
10861 - CCATTTGATGTTGTTAGACAATGCTCTGGTGTTACCTTCCAAGGTAAGTTCAAGAAAATT - 10920
       - P  F  D  V  V  R  Q  C  S  G  V  T  F  Q  G  K  F  K  K  I
       - H  L  M  L  L  D  N  A  L  V  L  P  S  K  V  S  S  R  K  L
       - I  *  C  C  *  T  M  L  W  C  Y  L  P  R  *  V  Q  E  N  C
```

FIG. 11 Con't

```
10921 - GTTAAGGGCACTCATCATTGGATGCTTTTAACTTTCTTGACATCACTATTGATTCTTGTT - 10980
      -  V  K  G  T  H  H  W  M  L  L  T  F  L  T  S  L  L  I  L  V
      -   L  R  A  L  I  I  G  C  F  *  L  S  *  H  H  Y  *  F  L  F
      -    *  G  H  S  S  L  D  A  F  N  F  L  D  I  T  I  D  S  C  S
10981 - CAAAGTACACAGTGGTCACTGTTTTCTTTGTTTACGAGAATGCTTTCTTGCCATTTACT - 11040
      -  Q  S  T  Q  W  S  L  F  F  F  V  Y  E  N  A  F  L  P  F  T
      -   K  V  H  S  G  H  C  F  S  L  F  T  R  M  L  S  C  H  L  L
      -    K  Y  T  V  V  T  V  F  L  C  L  R  E  C  F  L  A  I  Y  S
11041 - CTTGGTATTATGGCAATTGCTGCATGTGCTATGCTGCTTGTTAAGCATAAGCACGCATTC - 11100
      -  L  G  I  M  A  I  A  A  C  A  M  L  L  V  K  H  K  H  A  F
      -   L  V  L  W  Q  L  L  H  V  L  C  C  L  L  S  I  S  T  H  S
      -    W  Y  Y  G  N  C  C  M  C  Y  A  A  C  *  A  *  A  R  I  L
11101 - TTGTGCTTGTTTCTGTTACCTTCTCTTGCAACAGTTGCTTACTTTAATATGGTCTACATG - 11160
      -  L  C  L  F  L  L  P  S  L  A  T  V  A  Y  F  N  M  V  Y  M
      -   C  A  C  F  C  Y  L  L  L  Q  Q  L  L  T  L  I  W  S  T  C
      -    V  L  V  S  V  T  F  S  C  N  S  C  L  L  *  Y  G  L  H  A
11161 - CCTGCTAGCTGGGTGATGCGTATCATGACATGGCTTGAATTGGCTGACACTAGCTTGTCT - 11220
      -  P  A  S  W  V  M  R  I  M  T  W  L  E  L  A  D  T  S  L  S
      -   L  L  A  G  *  C  V  S  *  H  G  L  N  W  L  T  L  A  C  L
      -    C  *  L  G  D  A  Y  H  D  M  A  *  I  G  *  H  *  L  V  W
11221 - GGTTATAGGCTTAAGGATTGTGTTATGTATGCTTCAGCTTTAGTTTTGCTTATTCTCATG - 11280
      -  G  Y  R  L  K  D  C  V  M  Y  A  S  A  L  V  L  L  I  L  M
      -   V  I  G  L  R  I  V  L  C  M  L  Q  L  *  F  C  L  F  S  *
      -    L  *  A  *  G  L  C  Y  V  C  F  S  F  S  F  A  Y  S  H  D
11281 - ACAGCTCGCACTGTTTATGATGATGCTGCTAGACGTGTTTGGACACTGATGAATGTCATT - 11340
      -  T  A  R  T  V  Y  D  D  A  A  R  R  V  W  T  L  M  N  V  I
      -   Q  L  A  L  F  M  M  M  L  L  D  V  F  G  H  *  *  M  S  L
      -    S  S  H  C  L  *  *  C  C  *  T  C  L  D  T  D  E  C  H  Y
11341 - ACACTTGTTTACAAAGTCTACTATGGTAATGCTTTAGATCAAGCTATTTCCATGTGGGCC - 11400
      -  T  L  V  Y  K  V  Y  Y  G  N  A  L  D  Q  A  I  S  M  W  A
      -   H  L  F  T  K  S  T  M  V  M  L  *  I  K  L  F  P  C  G  P
      -    T  C  L  Q  S  L  L  W  *  C  F  R  S  S  Y  F  H  V  G  L
11401 - TTAGTTATTTCTGTAACCTCTAACTATTCTGGTGTCGTTACGACTATCATGTTTTTAGCT - 11460
      -  L  V  I  S  V  T  S  N  Y  S  G  V  V  T  T  I  M  F  L  A
      -   *  L  F  L  *  P  L  T  I  L  V  S  L  R  L  S  C  F  *  L
      -    S  Y  F  C  N  L  *  L  F  W  C  R  Y  D  Y  H  V  F  S  *
11461 - AGAGCTATAGTGTTTGTGTGTGTTGAGTATTACCCATTGTTATTTATTACTGGCAACACC - 11520
      -  R  A  I  V  F  V  C  V  E  Y  Y  P  L  L  F  I  T  G  N  T
      -   E  L  *  C  L  C  V  L  S  I  T  H  C  Y  L  L  A  T  P
      -    S  Y  S  V  C  V  C  *  V  L  P  I  V  I  Y  Y  W  Q  H  L
11521 - TTACAGTGTATCATGCTTGTTTATTGTTTCTTAGGCTATTGTTGCTGCTGCTACTTTGGC - 11580
      -  L  Q  C  I  M  L  V  Y  C  F  L  G  Y  C  C  C  C  Y  F  G
      -   Y  S  V  S  C  L  F  I  V  S  *  A  I  V  A  A  A  T  L  A
      -    T  V  Y  H  A  C  L  L  F  L  R  L  L  L  L  L  L  W  P
11581 - CTTTTCTGTTTACTCAACCGTTACTTCAGGCTTACTCTTGGTGTTATGACTACTTGGTC - 11640
      -  L  F  C  L  L  N  R  Y  F  R  L  T  L  G  V  Y  D  Y  L  V
      -   F  S  V  Y  S  T  V  T  S  G  L  L  L  V  F  M  T  T  W  S
      -    F  L  F  T  Q  P  L  L  Q  A  Y  S  W  C  L  *  L  L  G  L
11641 - TCTACACAAGAATTTAGGTATATGAACTCCCAGGGGCTTTTGCCTCCTAAGAGTAGTATT - 11700
      -  S  T  Q  E  F  R  Y  M  N  S  Q  G  L  L  P  P  K  S  S  I
      -   L  H  K  N  L  G  I  *  T  P  R  G  F  C  L  L  R  V  V  L
      -    Y  T  R  I  *  V  Y  E  L  P  G  A  F  A  S  *  E  *  Y  *
11701 - GATGCTTTCAAGCTTAACATTAAGTTGTTGGGTATTGGAGGTAAACCATGTATCAAGGTT - 11760
      -  D  A  F  K  L  N  I  K  L  L  G  I  G  G  K  P  C  I  K  V
      -   M  L  S  S  L  T  L  S  C  W  V  L  E  V  N  H  V  S  R  L
      -    C  F  Q  A  *  H  *  V  V  G  Y  W  R  *  T  M  Y  Q  G  C
```

FIG. 11 Con't

```
11761 - GCTACTGTACAGTCTAAAATGTCTGACGTAAAGTGCACATCTGTGGTACTGCTCTCGGTT - 11820
       - A  T  V  Q  S  K  M  S  D  V  K  C  T  S  V  V  L  L  S  V
       -  L  L  Y  S  L  K  C  L  T  *  S  A  H  L  W  Y  C  S  R  F
       -   Y  C  T  V  *  N  V  *  R  K  V  H  I  C  G  T  A  L  G  S
11821 - CTTCAACAACTTAGAGTAGAGTCATCTTCTAAATTGTGGGCACAATGTGTACAACTCCAC - 11880
       - L  Q  Q  L  R  V  E  S  S  S  K  L  W  A  Q  C  V  Q  L  H
       -  F  N  N  L  E  *  S  H  L  L  N  C  G  H  N  V  Y  N  S  T
       -   S  T  T  *  S  R  V  I  F  *  I  V  G  T  M  C  T  T  P  Q
11881 - AATGATATTCTTCTTGCAAAAGACACAACTGAAGCTTTCGAGAAGATGGTTTCTCTTTTG - 11940
       - N  D  I  L  L  A  K  D  T  T  E  A  F  E  K  M  V  S  L  L
       -  M  I  F  F  L  Q  K  T  Q  L  K  L  S  R  R  W  F  L  F  C
       -   *  Y  S  S  C  K  R  H  N  *  S  F  R  E  D  G  F  S  F  V
11941 - TCTGTTTTGCTATCCATGCAGGGTGCTGTAGACATTAATAGGTTGTGCGAGGAAATGCTC - 12000
       - S  V  L  L  S  M  Q  G  A  V  D  I  N  R  L  C  E  E  M  L
       -  L  F  C  Y  P  C  R  V  L  *  T  L  I  G  C  A  R  K  C  S
       -   C  F  A  I  H  A  G  C  C  R  H  *  *  V  V  R  G  N  A  R
12001 - GATAACCGTGCTACTCTTCAGGCTATTGCTTCAGAATTTAGTTCTTTACCATCATATGCC - 12060
       - D  N  R  A  T  L  Q  A  I  A  S  E  F  S  S  L  P  S  Y  A
       -  I  T  V  L  L  F  R  L  L  L  Q  N  L  V  L  Y  H  H  M  P
       -   *  P  C  Y  S  S  G  Y  C  F  R  I  *  F  F  T  I  I  C  R
12061 - GCTTATGCCACTGCCCAGGAGGCCTATGAGCAGGCTGTAGCTAATGGTGATTCTGAAGTC - 12120
       - A  Y  A  T  A  Q  E  A  Y  E  Q  A  V  A  N  G  D  S  E  V
       -  L  M  P  L  P  R  R  P  M  S  R  L  *  L  M  V  I  L  K  S
       -   L  C  H  C  P  G  G  L  *  A  G  C  S  *  W  *  F  *  S  R
12121 - GTTCTCAAAAAGTTAAAGAAATCTTTGAATGTGGCTAAATCTGAGTTTGACCGTGATGCT - 12180
       - V  L  K  K  L  K  K  S  L  N  V  A  K  S  E  F  D  R  D  A
       -  F  S  K  S  *  R  N  L  *  M  W  L  N  L  S  L  T  V  M  L
       -   S  Q  K  V  K  E  I  F  E  C  G  *  I  *  V  *  P  *  C  C
12181 - GCCATGCAACGCAAGTTGGAAAAGATGGCAGATCAGGCTATGACCCAAATGTACAAACAG - 12240
       - A  M  Q  R  K  L  E  K  M  A  D  Q  A  M  T  Q  M  Y  K  Q
       -  P  C  N  A  S  W  K  R  W  Q  I  R  L  *  P  K  C  T  N  R
       -   H  A  T  Q  V  G  K  D  G  R  S  G  Y  D  P  N  V  Q  T  G
12241 - GCAAGATCTGAGGACAAGAGGGCAAAAGTAACTAGTGCTATGCAAACAATGCTCTTCACT - 12300
       - A  R  S  E  D  K  R  A  K  V  T  S  A  M  Q  T  M  L  F  T
       -  Q  D  L  R  T  R  G  Q  K  *  L  V  L  C  K  Q  C  S  S  L
       -   K  I  *  G  Q  E  G  K  S  N  *  C  Y  A  N  N  A  L  H  Y
12301 - ATGCTTAGGAAGCTTGATAATGATGCACTTAACAACATTATCAACAATGCGCGTGATGGT - 12360
       - M  L  R  K  L  D  N  D  A  L  N  N  I  I  N  N  A  R  D  G
       -  C  L  G  S  L  I  M  M  H  L  T  T  L  S  T  M  R  V  M  V
       -   A  *  E  A  *  *  *  C  T  *  Q  H  Y  Q  Q  C  A  *  W  L
12361 - TGTGTTCCACTCAACATCATACCATTGACTACAGCAGCCAAACTCATGGTTGTTGTCCCT - 12420
       - C  V  P  L  N  I  I  P  L  T  T  A  A  K  L  M  V  V  V  P
       -  V  F  H  S  T  S  Y  H  *  L  Q  Q  P  N  S  W  L  L  S  L
       -   C  S  T  Q  H  H  T  I  D  Y  S  S  Q  T  H  G  C  C  P  *
12421 - GATTATGGTACCTACAAGAACACTTGTGATGGTAACACCTTTACATATGCATCTGCACTC - 12480
       - D  Y  G  T  Y  K  N  T  C  D  G  N  T  F  T  Y  A  S  A  L
       -  I  M  V  P  T  R  T  L  V  M  V  T  P  L  H  M  H  L  H  S
       -   L  W  Y  L  Q  E  H  L  *  W  *  H  L  Y  I  C  I  C  T  L
12481 - TGGGAAATCCAGCAAGTTGTTGATGCGGATAGCAAGATTGTTCAACTTAGTGAAATTAAC - 12540
       - W  E  I  Q  Q  V  V  D  A  D  S  K  I  V  Q  L  S  E  I  N
       -  G  K  S  S  K  L  L  M  R  I  A  R  L  F  N  L  V  K  L  T
       -   G  N  P  A  S  C  *  C  G  *  Q  D  C  S  T  *  *  N  *  H
12541 - ATGGACAATTCACCAAATTTGGCTTGGCCTCTTATTGTTACAGCTCTAAGAGCCAACTCA - 12600
       - M  D  N  S  P  N  L  A  W  P  L  I  V  T  A  L  R  A  N  S
       -  W  T  I  H  Q  I  W  L  G  L  L  L  L  Q  L  *  E  P  T  Q
       -   G  Q  F  T  K  F  G  L  A  S  Y  C  Y  S  S  K  S  Q  L  S
```

FIG. 11 Con't

```
12601 - GCTGTTAAACTACAGAATAATGAACTGAGTCCAGTAGCACTACGACAGATGTCCTGTGCG - 12660
       - A  V  K  L  Q  N  N  E  L  S  P  V  A  L  R  Q  M  S  C  A
       - L  L  N  Y  R  I  M  N  *  V  Q  *  H  Y  D  R  C  P  V  R
       - C  *  T  T  E  *  *  T  E  S  S  S  T  T  T  D  V  L  C  G
12661 - GCTGGTACCACACAAACAGCTTGTACTGATGACAATGCACTTGCCTACTATAACAATTCG - 12720
       - A  G  T  T  Q  T  A  C  T  D  D  N  A  L  A  Y  Y  N  N  S
       - L  V  P  H  K  Q  L  V  L  M  T  M  H  L  P  T  I  T  I  R
       - W  Y  H  T  N  S  L  Y  *  *  Q  C  T  C  L  L  *  Q  F  E
12721 - AAGGGAGGTAGGTTTGTGCTGGCATTACTATCAGACCACCAAGATCTCAAATGGGCTAGA - 12780
       - K  G  G  R  F  V  L  A  L  L  S  D  H  Q  D  L  K  W  A  R
       - R  E  V  G  L  C  W  H  Y  Y  Q  T  T  K  I  S  N  G  L  D
       - G  R  *  V  C  A  G  I  T  I  R  P  P  R  S  Q  M  G  *  I
12781 - TTCCCTAAGAGTGATGGTACAGGTACAATTTACACAGAACTGGAACCACCTTGTAGGTTT - 12840
       - F  P  K  S  D  G  T  G  T  I  Y  T  E  L  E  P  P  C  R  F
       - S  L  R  V  M  V  Q  V  Q  F  T  Q  N  W  N  H  L  V  G  L
       - P  *  E  *  W  Y  R  Y  N  L  H  R  T  G  T  T  L  *  V  C
12841 - GTTACAGACACACCAAAAGGGCCTAAAGTGAAATACTTGTACTTCATCAAAGGCTTAAAC - 12900
       - V  T  D  T  P  K  G  P  K  V  K  Y  L  Y  F  I  K  G  L  N
       - L  Q  T  H  Q  K  G  L  K  *  N  T  C  T  S  S  K  A  *  T
       - Y  R  H  T  K  R  A  *  S  E  I  L  V  L  H  Q  R  L  K  Q
12901 - AACCTAAATAGAGGTATGGTGCTGGGCAGTTTAGCTGCTACAGTACGTCTTCAGGCTGGA - 12960
       - N  L  N  R  G  M  V  L  G  S  L  A  A  T  V  R  L  Q  A  G
       - T  *  I  E  V  W  C  W  A  V  *  L  L  Q  Y  V  F  R  L  E
       - P  K  *  R  Y  G  A  G  Q  F  S  C  Y  S  T  S  S  G  W  K
12961 - AATGCTACAGAAGTACCTGCCAATTCAACTGTGCTTTCCTTCTGTGCTTTTGCAGTAGAC - 13020
       - N  A  T  E  V  P  A  N  S  T  V  L  S  F  C  A  F  A  V  D
       - M  L  Q  K  Y  L  P  I  Q  L  C  F  P  S  V  L  L  Q  *  T
       - C  Y  R  S  T  C  Q  F  N  C  A  F  L  L  C  F  C  S  R  P
13021 - CCTGCTAAAGCATATAAGGATTACCTAGCAAGTGGAGGACAACCAATCACCAACTGTGTG - 13080
       - P  A  K  A  Y  K  D  Y  L  A  S  G  G  Q  P  I  T  N  C  V
       - L  L  K  H  I  R  I  T  *  Q  V  E  D  N  Q  S  P  T  V  *
       - C  *  S  I  *  G  L  P  S  K  W  R  T  T  N  H  Q  L  C  E
13081 - AAGATGTTGTGTACACACACTGGTACAGGACAGGCAATTACTGTAACACCAGAAGCTAAC - 13140
       - K  M  L  C  T  H  T  G  T  G  Q  A  I  T  V  T  P  E  A  N
       - R  C  C  V  H  T  L  V  Q  D  R  Q  L  L  *  H  Q  K  L  T
       - D  V  V  Y  T  H  W  Y  R  T  G  N  Y  C  N  T  R  S  *  H
13141 - ATGGACCAAGAGTCCTTTGGTGGTGCTTCATGTTGTCTGTATTGTAGATGCCACATTGAC - 13200
       - M  D  Q  E  S  F  G  G  A  S  C  C  L  Y  C  R  C  H  I  D
       - W  T  K  S  P  L  V  V  L  H  V  V  C  I  V  D  A  T  L  T
       - G  P  R  V  L  W  W  C  F  M  L  S  V  L  *  M  P  H  *  P
13201 - CATCCAAATCCTAAAGGATTCTGTGACTTGAAAGGTAAGTACGTCCAAATACCTACCACT - 13260
       - H  P  N  P  K  G  F  C  D  L  K  G  K  Y  V  Q  I  P  T  T
       - I  Q  I  L  K  D  S  V  T  *  K  V  S  T  S  K  Y  L  P  L
       - S  K  S  *  R  I  L  *  L  E  R  *  V  R  P  N  T  Y  H  L
13261 - TGTGCTAATGACCCAGTGGGTTTTACACTTAGAAACACAGTCTGTACCGTCTGCGGAATG - 13320
       - C  A  N  D  P  V  G  F  T  L  R  N  T  V  C  T  V  C  G  M
       - V  L  M  T  Q  W  V  L  H  L  E  T  Q  S  V  P  S  A  E  C
       - C  *  *  P  S  G  F  Y  T  *  K  H  S  L  Y  R  L  R  N  V
13321 - TGGAAAGGTTATGGCTGTAGTTGTGACCAACTCCGCGAACCCTTGATGCAGTCTGCGGAT - 13380
       - W  K  G  Y  G  C  S  C  D  Q  L  R  E  P  L  M  Q  S  A  D
       - G  K  V  M  A  V  V  V  T  N  S  A  N  P  *  C  S  L  R  M
       - E  R  L  W  L  *  L  *  P  T  P  R  T  L  D  A  V  C  G  C
13381 - GCATCAACGTTTTTAAACGGGTTTGCGGTGTAAGTGCAGCCCGTCTTACACCGTGCGGCA - 13440
       - A  S  T  F  L  N  G  F  A  V  *  V  Q  P  V  L  H  R  A  A
       - H  Q  R  F  *  T  G  L  R  C  K  C  S  P  S  Y  T  V  R  H
       - I  N  V  F  K  R  V  C  G  V  S  A  A  R  L  T  P  C  G  T
```

FIG. 11 Con't

```
13441 - CAGGCACTAGTACTGATGTCGTCTACAGGGCTTTTGATATTTACAACGAAAAAAGTGCTG - 13500
      - Q  A  L  V  L  M  S  S  T  G  L  L  I  F  T  T  K  K  V  L
      - R  H  *  Y  *  C  R  L  Q  G  F  *  Y  L  Q  R  K  K  C  W
      - G  T  S  T  D  V  V  Y  R  A  F  D  I  Y  N  E  K  S  A  G
13501 - GTTTTGCAAAGTTCCTAAAAACTAATTGCTGTCGCTTCCAGGAGAAGGATGAGGAAGGCA - 13560
      - V  L  Q  S  S  *  K  L  I  A  V  A  S  R  R  R  M  R  K  A
      - F  C  K  V  P  K  N  *  L  L  S  L  P  G  E  G  *  G  R  Q
      - F  A  K  F  L  K  T  N  C  C  R  F  Q  E  K  D  E  E  G  N
13561 - ATTTATTAGACTCTTACTTTGTAGTTAAGAGGCATACTATGTCTAACTACCAACATGAAG - 13620
      - I  Y  *  T  L  T  L  *  L  R  G  I  L  C  L  T  T  N  M  K
      - F  I  R  L  L  L  C  S  *  E  A  Y  Y  V  *  L  P  T  *  R
      - L  L  D  S  Y  F  V  V  K  R  H  T  M  S  N  Y  Q  H  E  E
13621 - AGACTATTTATAACTTGGTTAAAGATTGTCCAGCGGTTGCTGTCCATGACTTTTTCAAGT - 13680
      - R  L  F  I  T  W  L  K  I  V  Q  R  L  L  S  M  T  F  S  S
      - D  Y  L  *  L  G  *  R  L  S  S  G  C  C  P  *  L  F  Q  V
      - T  I  Y  N  L  V  K  D  C  P  A  V  A  V  H  D  F  F  K  F
13681 - TTAGAGTAGATGGTGACATGGTACCACATATATCACGTCAGCGTCTAACTAAATACACAA - 13740
      - L  E  *  M  V  T  W  Y  H  I  Y  H  V  S  V  *  L  N  T  Q
      - *  S  R  W  *  H  G  T  T  Y  I  T  S  A  S  N  *  I  H  N
      - R  V  D  G  D  M  V  P  H  I  S  R  Q  R  L  T  K  Y  T  M
13741 - TGGCTGATTTAGTCTATGCTCTACGTCATTTTGATGAGGGTAATTGTGATACATTAAAAG - 13800
      - W  L  I  *  S  M  L  Y  V  I  L  M  R  V  I  V  I  H  *  K
      - G  *  F  S  L  C  S  T  S  F  *  *  G  *  L  *  Y  I  K  R
      - A  D  L  V  Y  A  L  R  H  F  D  E  G  N  C  D  T  L  K  E
13801 - AAATACTCGTCACATACAATTGCTGTGATGATGATTATTTCAATAAGAAGGATTGGTATG - 13860
      - K  Y  S  S  H  T  I  A  V  M  M  I  I  S  I  R  R  I  G  M
      - N  T  R  H  I  Q  L  L  *  *  *  L  F  Q  *  E  G  L  V  *
      - I  L  V  T  Y  N  C  C  D  D  D  Y  F  N  K  K  D  W  Y  D
13861 - ACTTCGTAGAGAATCCTGACATCTTACGCGTATATGCTAACTTAGGTGAGCGTGTACGCC - 13920
      - T  S  *  R  I  L  T  S  Y  A  Y  M  L  T  *  V  S  V  Y  A
      - L  R  R  E  S  *  H  L  T  R  I  C  *  L  R  *  A  C  T  P
      - F  V  E  N  P  D  I  L  R  V  Y  A  N  L  G  E  R  V  R  Q
13921 - AATCATTATTAAAGACTGTACAATTCTGCGATGCTATGCGTGATGCAGGCATTGTAGGCG - 13980
      - N  H  Y  *  R  L  Y  N  S  A  M  L  C  V  M  Q  A  L  *  A
      - I  I  I  K  D  C  T  I  L  R  C  Y  A  *  C  R  H  C  R  R
      - S  L  L  K  T  V  Q  F  C  D  A  M  R  D  A  G  I  V  G  V
13981 - TACTGACATTAGATAATCAGGATCTTAATGGGAACTGGTACGATTTCGGTGATTTCGTAC - 14040
      - Y  *  H  *  I  I  R  I  L  M  G  T  G  T  I  S  V  I  S  Y
      - T  D  I  R  *  S  G  S  *  W  E  L  V  R  F  R  *  F  R  T
      - L  T  L  D  N  Q  D  L  N  G  N  W  Y  D  F  G  D  F  V  Q
14041 - AAGTAGCACCAGGCTGCGGAGTTCCTATTGTGGATTCATATTACTCATTGCTGATGCCCA - 14100
      - K  *  H  Q  A  A  E  F  L  L  W  I  H  I  T  H  C  *  C  P
      - S  S  T  R  L  R  S  S  Y  C  G  F  I  L  L  I  A  D  A  H
      - V  A  P  G  C  G  V  P  I  V  D  S  Y  Y  S  L  L  M  P  I
14101 - TCCTCACTTTGACTAGGGCATTGGCTGCTGAGTCCCATATGGATGCTGATCTCGCAAAAC - 14160
      - S  S  L  *  L  G  H  W  L  L  S  P  I  W  M  L  I  S  Q  N
      - P  H  F  D  *  G  I  G  C  *  V  P  Y  G  C  *  S  R  K  T
      - L  T  L  T  R  A  L  A  A  E  S  H  M  D  A  D  L  A  K  P
14161 - CACTTATTAAGTGGGATTTGCTGAAATATGATTTTACGGAAGAGAGACTTTGTCTCTTCG - 14220
      - H  L  L  S  G  I  C  *  N  M  I  L  R  K  R  D  F  V  S  S
      - T  Y  *  V  G  F  A  E  I  *  F  Y  G  R  E  T  L  S  L  R
      - L  I  K  W  D  L  L  K  Y  D  F  T  E  E  R  L  C  L  F  D
14221 - ACCGTTATTTTAAATATTGGGACCAGACATACCATCCCAATTGTATTAACTGTTTGGATG - 14280
      - T  V  I  L  N  I  G  T  R  H  T  I  P  I  V  L  T  V  W  M
      - P  L  F  *  I  L  G  P  D  I  P  S  Q  L  Y  *  L  F  G  *
      - R  Y  F  K  Y  W  D  Q  T  Y  H  P  N  C  I  N  C  L  D  D
```

FIG. 11 Con't

```
14281 - ATAGGTGTATCCTTCATTGTGCAAACTTTAATGTGTTATTTTCTACTGTGTTTCCACCTA - 14340
      - I  G  V  S  F  I  V  Q  T  L  M  C  Y  F  L  L  C  F  H  L
      - *  V  Y  P  S  L  C  K  L  *  C  V  I  F  Y  C  V  S  T  Y
      -    R  C  I  L  H  C  A  N  F  N  V  L  F  S  T  V  F  P  P  T
14341 - CAAGTTTTGGACCACTAGTAAGAAAAATATTTGTAGATGGTGTTCCTTTTGTTGTTTCAA - 14400
      - Q  V  L  D  H  *  *  E  K  Y  L  *  M  V  F  L  L  L  F  Q
      - K  F  W  T  T  S  K  K  N  I  C  R  W  C  S  F  C  C  F  N
      -   S  F  G  P  L  V  R  K  I  F  V  D  G  V  P  F  V  V  S  T
14401 - CTGGATACCATTTTCGTGAGTTAGGAGTCGTACATAATCAGGATGTAAACTTACATAGCT - 14460
      - L  D  T  I  F  V  S  *  E  S  Y  I  I  R  M  *  T  Y  I  A
      - W  I  P  F  S  *  V  R  S  R  T  *  S  G  C  K  L  T  *  L
      -   G  Y  H  F  R  E  L  G  V  V  H  N  Q  D  V  N  L  H  S  S
14461 - CGCGTCTCAGTTTCAAGGAACTTTTAGTGTATGCTGCTGATCCAGCTATGCATGCAGCTT - 14520
      - R  V  S  V  S  R  N  F  *  C  M  L  L  I  Q  L  C  M  Q  L
      - A  S  Q  F  Q  G  T  F  S  V  C  C  *  S  S  Y  A  C  S  F
      -   R  L  S  F  K  E  L  L  V  Y  A  A  D  P  A  M  H  A  A  S
14521 - CTGGCAATTTATTGCTAGATAAACGCACTACATGCTTTTCAGTAGCTGCACTAACAAACA - 14580
      - L  A  I  Y  C  *  I  N  A  L  H  A  F  Q  *  L  H  *  Q  T
      - W  Q  F  I  A  R  *  T  H  Y  M  L  F  S  S  C  T  N  K  Q
      -   G  N  L  L  L  D  K  R  T  T  C  F  S  V  A  A  L  T  N  N
14581 - ATGTTGCTTTTCAAACTGTCAAACCCGGTAATTTTAATAAAGACTTTTATGACTTTGCTG - 14640
      - M  L  L  F  K  L  S  N  P  V  I  L  I  K  T  F  M  T  L  L
      - C  C  F  S  N  C  Q  T  R  *  F  *  *  R  L  L  *  L  C  C
      -   V  A  F  Q  T  V  K  P  G  N  F  N  K  D  F  Y  D  F  A  V
14641 - TGTCTAAAGGTTTCTTTAAGGAAGGAAGTTCTGTTGAACTAAAACACTTCTTCTTTGCTC - 14700
      - C  L  K  V  S  L  R  K  E  V  L  L  N  *  N  T  S  S  L  L
      - V  *  R  F  L  *  G  R  K  F  C  *  T  K  T  L  L  L  C  S
      -   S  K  G  F  F  K  E  G  S  S  V  E  L  K  H  F  F  F  A  Q
14701 - AGGATGGCAACGCTGCTATCAGTGATTATGACTATTATCGTTATAATCTGCCAACAATGT - 14760
      - R  M  A  T  L  L  S  V  I  M  T  I  I  V  I  I  C  Q  Q  C
      - G  W  Q  R  C  Y  Q  *  L  *  L  L  S  L  *  S  A  N  N  V
      -   D  G  N  A  A  I  S  D  Y  D  Y  Y  R  Y  N  L  P  T  M  C
14761 - GTGATATCAGACAACTCCTATTCGTAGTTGAAGTTGTTGATAAATACTTTGATTGTTACG - 14820
      - V  I  S  D  N  S  Y  S  *  L  K  L  L  I  N  T  L  I  V  T
      - *  Y  Q  T  T  P  I  R  S  *  S  C  *  *  I  L  *  L  L  R
      -   D  I  R  Q  L  L  F  V  V  E  V  V  D  K  Y  F  D  C  Y  D
14821 - ATGGTGGCTGTATTAATGCCAACCAAGTAATCGTTAACAATCTGGATAAATCAGCTGGTT - 14880
      - M  V  A  V  L  M  P  T  K  *  S  L  T  I  W  I  N  Q  L  V
      - W  W  L  Y  *  C  Q  P  S  N  R  *  Q  S  G  *  I  S  W  F
      -   G  G  C  I  N  A  N  Q  V  I  V  N  N  L  D  K  S  A  G  F
14881 - TCCCATTTAATAAATGGGGTAAGGCTAGACTTTATTATGACTCAATGAGTTATGAGGATC - 14940
      - S  H  L  I  N  G  V  R  L  D  F  I  M  T  Q  *  V  M  R  I
      - P  I  *  *  M  G  *  G  *  T  L  L  *  L  N  E  L  *  G  S
      -   P  F  N  K  W  G  K  A  R  L  Y  Y  D  S  M  S  Y  E  D  Q
14941 - AAGATGCACTTTTCGCGTATACTAAGCGTAATGTCATCCCTACTATAACTCAAATGAATC - 15000
      - K  M  H  F  S  R  I  L  S  V  M  S  S  L  L  *  L  K  *  I
      - R  C  T  F  R  V  Y  *  A  *  C  H  P  Y  Y  N  S  N  E  S
      -   D  A  L  F  A  Y  T  K  R  N  V  I  P  T  I  T  Q  M  N  L
15001 - TTAAGTATGCCATTAGTGCAAAGAATAGAGCTCGCACCGTAGCTGGTGTCTCTATCTGTA - 15060
      - L  S  M  P  L  V  Q  R  I  E  L  A  P  *  L  V  S  L  S  V
      - *  V  C  H  *  C  K  E  *  S  S  H  R  S  W  C  L  Y  L  *
      -   K  Y  A  I  S  A  K  N  R  A  R  T  V  A  G  V  S  I  C  S
15061 - GTACTATGACAAATAGACAGTTTCATCAGAAATTATTGAAGTCAATAGCCGCCACTAGAG - 15120
      - V  L  *  Q  I  D  S  F  I  R  N  Y  *  S  Q  *  P  P  L  E
      - Y  Y  D  K  *  T  V  S  S  E  I  I  E  V  N  S  R  H  *  R
      -   T  M  T  N  R  Q  F  H  Q  K  L  L  K  S  I  A  A  T  R  G
```

FIG. 11 Con't

```
15121 - GAGCTACTGTGGTAATTGGAACAAGCAAGTTTTACGGTGGCTGGCATAATATGTTAAAAA - 15180
      - E  L  L  W  *  L  E  Q  A  S  F  T  V  A  G  I  I  C  *  K
      -  S  Y  C  G  N  W  N  K  Q  V  L  R  W  L  A  *  Y  V  K  N
      -   A  T  V  V  I  G  T  S  K  F  Y  G  G  W  H  N  M  L  K  T
15181 - CTGTTTACAGTGATGTAGAAACTCCACACCTTATGGGTTGGGATTATCCAAAATGTGACA - 15240
      - L  F  T  V  M  *  K  L  H  T  L  W  V  G  I  I  Q  N  V  T
      -  C  L  Q  *  C  R  N  S  T  P  Y  G  L  G  L  S  K  M  *  Q
      -   V  Y  S  D  V  E  T  P  H  L  M  G  W  D  Y  P  K  C  D  R
15241 - GAGCCATGCCTAACATGCTTAGGATAATGGCCTCTCTTGTTCTTGCTCGCAAACATAACA - 15300
      - E  P  C  L  T  C  L  G  *  W  P  L  L  F  L  L  A  N  I  T
      -  S  H  A  *  H  A  *  D  N  G  L  S  C  S  C  S  Q  T  *  H
      -   A  M  P  N  M  L  R  I  M  A  S  L  V  L  A  R  K  H  N  T
15301 - CTTGCTGTAACTTATCACACCGTTTCTACAGGTTAGCTAACGAGTGTGCGCAAGTATTAA - 15360
      - L  A  V  T  Y  H  T  V  S  T  G  *  L  T  S  V  R  K  Y  *
      -  L  L  *  L  I  T  P  F  L  Q  V  S  *  R  V  C  A  S  I  K
      -   C  C  N  L  S  H  R  F  Y  R  L  A  N  E  C  A  Q  V  L  S
15361 - GTGAGATGGTCATGTGTGGCGGCTCACTATATGTTAAACCAGGTGGAACATCATCCGGTG - 15420
      - V  R  W  S  C  V  A  A  H  Y  M  L  N  Q  V  E  H  H  P  V
      -  *  D  G  H  V  W  R  L  T  I  C  *  T  R  W  N  I  I  R  *
      -   E  M  V  M  C  G  G  S  L  Y  V  K  P  G  G  T  S  S  G  D
15421 - ATGCTACAACTGCTTATGCTAATAGTGTCTTTAACATTTGTCAAGCTGTTACAGCCAATG - 15480
      - M  L  Q  L  L  M  L  I  V  S  L  T  F  V  K  L  L  Q  P  M
      -  C  Y  N  C  L  C  *  *  C  L  *  H  L  S  S  C  Y  S  Q  C
      -   A  T  T  A  Y  A  N  S  V  F  N  I  C  Q  A  V  T  A  N  V
15481 - TAAATGCACTTCTTTCAACTGATGGTAATAAGATAGCTGACAAGTATGTCCGCAATCTAC - 15540
      - *  M  H  F  F  Q  L  M  V  I  R  *  L  T  S  M  S  A  I  Y
      -  K  C  T  S  F  N  *  W  *  *  D  S  *  Q  V  C  P  Q  S  T
      -   N  A  L  L  S  T  D  G  N  K  I  A  D  K  Y  V  R  N  L  Q
15541 - AACACAGGCTCTATGAGTGTCTCTATAGAAATAGGGATGTTGATCATGAATTCGTGGATG - 15600
      - N  T  G  S  M  S  V  S  I  E  I  G  M  L  I  M  N  S  W  M
      -  T  Q  A  L  *  V  S  L  *  K  *  G  C  *  S  *  I  R  G  *
      -   H  R  L  Y  E  C  L  Y  R  N  R  D  V  D  H  E  F  V  D  E
15601 - AGTTTTACGCTTACCTGCGTAAACATTTCTCCATGATGATTCTTTCTGATGATGCCGTTG - 15660
      - S  F  T  L  T  C  V  N  I  S  P  *  *  F  F  L  M  M  P  L
      -  V  L  R  L  P  A  *  T  F  L  H  D  D  S  F  *  *  C  R  C
      -   F  Y  A  Y  L  R  K  H  F  S  M  M  I  L  S  D  D  A  V  V
15661 - TGTGCTATAACAGTAACTATGCGGCTCAAGGTTTAGTAGCTAGCATTAAGAACTTTAAGG - 15720
      - C  A  I  T  V  T  M  R  L  K  V  *  *  L  A  L  R  T  L  R
      -  V  L  *  Q  *  L  C  G  S  R  F  S  S  *  H  *  E  L  *  G
      -   C  Y  N  S  N  Y  A  A  Q  G  L  V  A  S  I  K  N  F  K  A
15721 - CAGTTCTTTATTATCAAAATAATGTGTTCATGTCTGAGGCAAAATGTTGGACTGAGACTG - 15780
      - Q  F  F  I  I  K  I  M  C  S  C  L  R  Q  N  V  G  L  R  L
      -  S  S  L  L  S  K  *  C  V  H  V  *  G  K  M  L  D  *  D  *
      -   V  L  Y  Y  Q  N  N  V  F  M  S  E  A  K  C  W  T  E  T  D
15781 - ACCTTACTAAAGGACCTCACGAATTTTGCTCACAGCATACAATGCTAGTTAAACAAGGAG - 15840
      - T  L  L  K  D  L  T  N  F  A  H  S  I  Q  C  *  L  N  K  E
      -  P  Y  *  R  T  S  R  I  L  L  T  A  Y  N  A  S  *  T  R  R
      -   L  T  K  G  P  H  E  F  C  S  Q  H  T  M  L  V  K  Q  G  D
15841 - ATGATTACGTGTACCTGCCTTACCCAGATCCATCAAGAATATTAGGCGCAGGCTGTTTTG - 15900
      - M  I  T  C  T  C  L  T  Q  I  H  Q  E  Y  *  A  Q  A  V  L
      -  *  L  R  V  P  A  L  P  R  S  I  K  N  I  R  R  R  L  F  C
      -   D  Y  V  V  Y  L  P  Y  P  D  P  S  R  I  L  G  A  G  C  F  V
15901 - TCGATGATATTGTCAAAACAGATGGTACACTTATGATTGAAAGGTTCGTGTCACTGGCTA - 15960
      - S  M  I  L  S  K  Q  M  V  H  L  *  L  K  G  S  C  H  W  L
      -  R  *  Y  C  Q  N  R  W  Y  T  Y  D  *  K  V  R  V  T  G  Y
      -   D  D  I  V  K  T  D  G  T  L  M  I  E  R  F  V  S  L  A  I
```

FIG. 11 Con't

```
15961 - TTGATGCTTACCCACTTACAAAACATCCTAATCAGGAGTATGCTGATGTCTTTCACTTGT - 16020
      -  L  M  L  T  H  L  Q  N  I  L  I  R  S  M  L  M  S  F  T  C
      -    *  C  L  P  T  Y  K  T  S  *  S  G  V  C  *  C  L  S  L  V
      -     D  A  Y  P  L  T  K  H  P  N  Q  E  Y  A  D  V  F  H  L  Y
16021 - ATTTACAATACATTAGAAAGTTACATGATGAGCTTACTGGCCACATGTTGGACATGTATT - 16080
      -  I  Y  N  T  L  E  S  Y  M  M  S  L  L  A  T  C  W  T  C  I
      -    F  T  I  H  *  K  V  T  *  *  A  Y  W  P  H  V  G  H  V  F
      -     L  Q  Y  I  R  K  L  H  D  E  L  T  G  H  M  L  D  M  Y  S
16081 - CCGTAATGCTAACTAATGATAACACCTCACGGTACTGGGAACCTGAGTTTTATGAGGCTA - 16140
      -  P  *  C  *  L  M  I  T  P  H  G  T  G  N  L  S  F  M  R  L
      -    R  N  A  N  *  *  *  H  L  T  V  L  G  T  *  V  L  *  G  Y
      -     V  M  L  T  N  D  N  T  S  R  Y  W  E  P  E  F  Y  E  A  M
16141 - TGTACACACCACATACAGTCTTGCAGGCTGTAGGTGCTTGTGTATTGTGCAATTCACAGA - 16200
      -  C  T  H  H  I  Q  S  C  R  L  *  V  L  V  Y  C  A  I  H  R
      -    V  H  T  T  Y  S  L  A  G  C  R  C  L  C  I  V  Q  F  T  D
      -     Y  T  P  H  T  V  L  Q  A  V  G  A  C  V  L  C  N  S  Q  T
16201 - CTTCACTTCGTTGCGGTGCCTGTATTAGGAGACCATTCCTATGTTGCAAGTGCTGCTATG - 16260
      -  L  H  F  V  A  V  P  V  L  G  D  H  S  Y  V  A  S  A  A  M
      -    F  T  S  L  R  C  L  Y  *  E  T  I  P  M  L  Q  V  L  L  *
      -     S  L  R  C  G  A  C  I  R  R  P  F  L  C  C  K  C  C  Y  D
16261 - ACCATGTCATTTCAACATCACACAAATTAGTGTTGTCTGTTAATCCCTATGTTTGCAATG - 16320
      -  T  M  S  F  Q  H  H  T  N  *  C  C  L  L  I  P  M  F  A  M
      -    P  C  H  F  N  I  T  Q  I  S  V  V  C  *  S  L  C  L  Q  C
      -     H  V  I  S  T  S  H  K  L  V  L  S  V  N  P  Y  V  C  N  A
16321 - CCCCAGGTTGTGATGTCACTGATGTGACACAACTGTATCTAGGAGGTATGAGCTATTATT - 16380
      -  P  Q  V  V  M  S  L  M  *  H  N  C  I  *  E  V  *  A  I  I
      -    P  R  L  *  C  H  *  C  D  T  T  V  S  R  R  Y  E  L  L  L
      -     P  G  C  D  V  T  D  V  T  Q  L  Y  L  G  G  M  S  Y  Y  C
16381 - GCAAGTCACATAAGCCTCCCATTAGTTTTCCATTATGTGCTAATGGTCAGGTTTTTGGTT - 16440
      -  A  S  H  I  S  L  P  L  V  F  H  Y  V  L  M  V  R  F  L  V
      -    Q  V  T  *  A  S  H  *  F  S  I  M  C  *  W  S  G  F  W  F
      -     K  S  H  K  P  P  I  S  F  P  L  C  A  N  G  Q  V  F  G  L
16441 - TATACAAAAACACATGTGTAGGCAGTGACAATGTCACTGACTTCAATGCGATAGCAACAT - 16500
      -  Y  T  K  T  H  V  *  A  V  T  M  S  L  T  S  M  R  *  Q  H
      -    I  Q  K  H  M  C  R  Q  *  Q  C  H  *  L  Q  C  D  S  N  M
      -     Y  K  N  T  C  V  G  S  D  N  V  T  D  F  N  A  I  A  T  C
16501 - GTGATTGGACTAATGCTGGCGATTACATACTTGCCAACACTTGTACTGAGAGACTCAAGC - 16560
      -  V  I  G  L  M  L  A  I  T  Y  L  P  T  L  V  L  R  D  S  S
      -    *  L  D  *  C  W  R  L  H  T  C  Q  H  L  Y  *  E  T  Q  A
      -     D  W  T  N  A  G  D  Y  I  L  A  N  T  C  T  E  R  L  K  L
16561 - TTTTCGCAGCAGAAACGCTCAAAGCCACTGAGGAAACATTTAAGCTGTCATATGGTATTG - 16620
      -  F  S  Q  Q  K  R  S  K  P  L  R  K  H  L  S  C  H  M  V  L
      -    F  R  S  R  N  A  Q  S  H  *  G  N  I  *  A  V  I  W  Y  C
      -     F  A  A  E  T  L  K  A  T  E  E  T  F  K  L  S  Y  G  I  A
16621 - CCACTGTACGCGAAGTACTCTCTGACAGAGAATTGCATCTTTCATGGGAGGTTGGAAAAC - 16680
      -  P  L  Y  A  K  Y  S  L  T  E  N  C  I  F  H  G  R  L  E  N
      -    H  C  T  R  S  T  L  *  Q  R  I  A  S  F  M  G  G  W  K  T
      -     T  V  R  E  V  L  S  D  R  E  L  H  L  S  W  E  V  G  K  P
16681 - CTAGACCACCATTGAACAGAAACTATGTCTTTACTGGTTACCGTGTAACTAAAAATAGTA - 16740
      -  L  D  H  H  *  T  E  T  M  S  L  L  V  T  V  *  L  K  I  V
      -    *  T  T  I  E  Q  K  L  C  L  Y  W  L  P  C  N  *  K  *  *
      -     R  P  P  L  N  R  N  Y  V  F  T  G  Y  R  V  T  K  N  S  K
16741 - AAGTACAGATTGGAGAGTACACCTTTGAAAAAGGTGACTATGGTGATGCTGTTGTGTACA - 16800
      -  K  Y  R  L  E  S  T  P  L  K  K  V  T  M  V  M  L  L  C  T
      -    S  T  D  W  R  V  H  L  *  K  R  *  L  W  *  C  C  C  V  Q
      -     V  Q  I  G  E  Y  T  F  E  K  G  D  Y  G  D  A  V  V  Y  R
```

FIG. 11 Con't

```
16801 - GAGGTACTACGACATACAAGTTGAATGTTGGTGATTACTTTGTGTTGACATCTCACACTG - 16860
       - E  V  L  R  H  T  S  *  M  L  V  I  T  L  C  *  H  L  T  L
       -  R  Y  Y  D  I  Q  V  E  C  W  *  L  L  C  V  D  I  S  H  C
       -   G  T  T  T  Y  K  L  N  V  G  D  Y  F  V  L  T  S  H  T  V
16861 - TAATGCCACTTAGTGCACCTACTCTAGTGCCACAAGAGCACTATGTGAGAATTACTGGCT - 16920
       - *  C  H  L  V  H  L  L  *  C  H  K  S  T  M  *  E  L  L  A
       -  N  A  T  *  C  T  Y  S  S  A  T  R  A  L  C  E  N  Y  W  L
       -   M  P  L  S  A  P  T  L  V  P  Q  E  H  Y  V  R  I  T  G  L
16921 - TGTACCCAACACTCAACATCTCAGATGAGTTTTCTAGCAATGTTGCAAATTATCAAAAGG - 16980
       - C  T  Q  H  S  T  S  Q  M  S  F  L  A  M  L  Q  I  I  K  R
       -  V  P  N  T  Q  H  L  R  *  V  F  *  Q  C  C  K  L  S  K  G
       -   Y  P  T  L  N  I  S  D  E  F  S  S  N  V  A  N  Y  Q  K  V
16981 - TCGGCATGCAAAAGTACTCTACACTCCAAGGACCACCTGGTACTGGTAAGAGTCATTTTG - 17040
       - S  A  C  K  S  T  L  H  S  K  D  H  L  V  L  V  R  V  I  L
       -  R  H  A  K  V  L  Y  T  P  R  T  T  W  Y  W  *  E  S  F  C
       -   G  M  Q  K  Y  S  T  L  Q  G  P  P  G  T  G  K  S  H  F  A
17041 - CCATCGGACTTGCTCTCTATTACCCATCTGCTCGCATAGTGTATACGGCATGCTCTCATG - 17100
       - P  S  D  L  L  S  I  T  H  L  L  A  *  C  I  R  H  A  L  M
       -  H  R  T  C  S  L  L  P  I  C  S  H  S  V  Y  G  M  L  S  C
       -   I  G  L  A  L  Y  Y  P  S  A  R  I  V  Y  T  A  C  S  H  A
17101 - CAGCTGTTGATGCCCTATGTGAAAAGGCATTAAAATATTTGCCCATAGATAAATGTAGTA - 17160
       - Q  L  L  M  P  Y  V  K  R  H  *  N  I  C  P  *  I  N  V  V
       -  S  C  *  C  P  M  *  K  G  I  K  I  F  A  H  R  *  M  *  *
       -   A  V  D  A  L  C  E  K  A  L  K  Y  L  P  I  D  K  C  S  R
17161 - GAATCATACCTGCGCGTGCGCGCGTAGAGTGTTTTGATAAATTCAAAGTGAATTCAACAC - 17220
       - E  S  Y  L  R  V  R  A  *  S  V  L  I  N  S  K  *  I  Q  H
       -  N  H  T  C  A  C  A  R  R  V  F  *  *  I  Q  S  E  F  N  T
       -   I  I  P  A  R  A  R  V  E  C  F  D  K  F  K  V  N  S  T  L
17221 - TAGAACAGTATGTTTTCTGCACTGTAAATGCATTGCCAGAAACAACTGCTGACATTGTAG - 17280
       - *  N  S  M  F  S  A  L  *  M  H  C  Q  K  Q  L  L  T  L  *
       -  R  T  V  C  F  L  H  C  K  C  I  A  R  N  N  C  *  H  C  S
       -   E  Q  Y  V  F  C  T  V  N  A  L  P  E  T  T  A  D  I  V  V
17281 - TCTTTGATGAAATCTCTATGGCTACTAATTATGACTTGAGTGTTGTCAATGCTAGACTTC - 17340
       - S  L  M  K  S  L  W  L  L  I  M  T  *  V  L  S  M  L  D  F
       -  L  *  *  N  L  Y  G  Y  *  L  *  L  E  C  C  Q  C  *  T  S
       -   F  D  E  I  S  M  A  T  N  Y  D  L  S  V  V  N  A  R  L  R
17341 - GTGCAAAACACTACGTCTATATTGGCGATCCTGCTCAATTACCAGCCCCCCGCACATTGC - 17400
       - V  Q  N  T  T  S  I  L  A  I  L  L  N  Y  Q  P  P  A  H  C
       -  C  K  T  L  R  L  Y  W  R  S  C  S  I  T  S  P  P  H  I  A
       -   A  K  H  Y  V  V  Y  I  G  D  P  A  Q  L  P  A  P  R  T  L  L
17401 - TGACTAAAGGCACACTAGAACCAGAATATTTTAATTCAGTGTGCAGACTTATGAAAACAA - 17460
       - *  L  K  A  H  *  N  Q  N  I  L  I  Q  C  A  D  L  *  K  Q
       -  D  *  R  H  T  R  T  R  I  F  *  F  S  V  Q  T  Y  E  N  N
       -   T  K  G  T  L  E  P  E  Y  F  N  S  V  C  R  L  M  K  T  I
17461 - TAGGTCCAGACATGTTCCTTGGAACTTGTCGCCGTTGTCCTGCTGAAATTGTTGACACTG - 17520
       - *  V  Q  T  C  S  L  E  L  V  A  V  V  L  L  K  L  L  T  L
       -  R  S  R  H  V  P  W  N  L  S  P  L  S  C  *  N  C  *  H  C
       -   G  P  D  M  F  L  G  T  C  R  R  C  P  A  E  I  V  D  T  V
17521 - TGAGTGCTTTAGTTTATGACAATAAGCTAAAAGCACACAAGGATAAGTCAGCTCAATGCT - 17580
       - *  V  L  *  F  M  T  I  S  *  K  H  T  R  I  S  Q  L  N  A
       -  E  C  F  S  L  *  Q  *  A  K  S  T  Q  G  *  V  S  S  M  L
       -   S  A  L  V  Y  D  N  K  L  K  A  H  K  D  K  S  A  Q  C  F
17581 - TCAAAATGTTCTACAAAGGTGTTATTACACATGATGTTTCATCTGCAATCAACAGACCTC - 17640
       - S  K  C  S  T  K  V  L  L  H  M  M  F  H  L  Q  S  T  D  L
       -  Q  N  V  L  Q  R  C  Y  Y  T  *  C  F  I  C  N  Q  Q  T  S
       -   K  M  F  Y  K  G  V  I  T  H  D  V  S  S  A  I  N  R  P  Q
```

FIG. 11 Con't

```
17641 - AAATAGGCGTTGTAAGAGAATTTCTTACACGCAATCCTGCTTGGAGAAAAGCTGTTTTA - 17700
      -  K  *  A  L  *  E  N  F  L  H  A  I  L  L  G  E  K  L  F  L
      -  N  R  R  C  K  R  I  S  Y  T  Q  S  C  L  E  K  S  C  F  Y
      -     I  G  V  V  R  E  F  L  T  R  N  P  A  W  R  K  A  V  F  I
17701 - TCTCACCTTATAATTCACAGAACGCTGTAGCTTCAAAAATCTTAGGATTGCCTACGCAGA - 17760
      -  S  H  L  I  I  H  R  T  L  *  L  Q  K  S  *  D  C  L  R  R
      -  L  T  L  *  F  T  E  R  C  S  F  K  N  L  R  I  A  Y  A  D
      -     S  P  Y  N  S  Q  N  A  V  A  S  K  I  L  G  L  P  T  Q  T
17761 - CTGTTGATTCATCACAGGGTTCTGAATATGACTATGTCATATTCACACAAACTACTGAAA - 17820
      -  L  L  I  H  H  R  V  L  N  M  T  M  S  Y  S  H  K  L  L  K
      -  C  *  F  I  T  G  F  *  I  *  L  C  H  I  H  T  N  Y  *  N
      -     V  D  S  S  Q  G  S  E  Y  D  Y  V  I  F  T  Q  T  T  E  T
17821 - CAGCACACTCTTGTAATGTCAACCGCTTCAATGTGGCTATCACAAGGGCAAAAATTGGCA - 17880
      -  Q  H  T  L  V  M  S  T  A  S  M  W  L  S  Q  G  Q  K  L  A
      -  S  T  L  L  *  C  Q  P  L  Q  C  G  Y  H  K  G  K  N  W  H
      -     A  H  S  C  N  V  N  R  F  N  V  A  I  T  R  A  K  I  G  I
17881 - TTTTGTGCATAATGTCTGATAGAGATCTTTATGACAAACTGCAATTTACAAGTCTAGAAA - 17940
      -  F  C  A  *  C  L  I  E  I  F  M  T  N  C  N  L  Q  V  *  K
      -  F  V  H  N  V  *  *  R  S  L  *  Q  T  A  I  Y  K  S  R  N
      -     L  C  I  M  S  D  R  D  L  Y  D  K  L  Q  F  T  S  L  E  I
17941 - TACCACGTCGCAATGTGGCTACATTACAAGCAGAAAATGTAACTGGACTTTTTAAGGACT - 18000
      -  Y  H  V  A  M  W  L  H  Y  K  Q  K  M  *  L  D  F  L  R  T
      -  T  T  S  Q  C  G  Y  I  T  S  R  K  C  N  W  T  F  *  G  L
      -     P  R  R  N  V  A  T  L  Q  A  E  N  V  T  G  L  F  K  D  C
18001 - GTAGTAAGATCATTACTGGTCTTCATCCTACACAGGCACCTACACACCTCAGCGTTGATA - 18060
      -  V  V  R  S  L  L  V  F  I  L  H  R  H  L  H  T  S  A  L  I
      -  *  *  D  H  Y  W  S  S  S  Y  T  G  T  Y  T  P  Q  R  *  Y
      -     S  K  I  I  T  G  L  H  P  T  Q  A  P  T  H  L  S  V  D  I
18061 - TAAAATTCAAGACTGAAGGATTATGTGTTGACATACCAGGCATACCAAAGGACATGACCT - 18120
      -  *  N  S  R  L  K  D  Y  V  L  T  Y  Q  A  Y  Q  R  T  *  P
      -  K  I  Q  D  *  R  I  M  C  *  H  T  R  H  T  K  G  H  D  L
      -     K  F  K  T  E  G  L  C  V  D  I  P  G  I  P  K  D  M  T  Y
18121 - ACCGTAGACTCATCTCTATGATGGGTTTCAAAATGAATTACCAAGTCAATGGTTACCCTA - 18180
      -  T  V  D  S  S  L  *  W  V  S  K  *  I  T  K  S  M  V  T  L
      -  P  *  T  H  L  Y  D  G  F  Q  N  E  L  P  S  Q  W  L  P  *
      -     R  R  L  I  S  M  M  G  F  K  M  N  Y  Q  V  N  G  Y  P  N
18181 - ATATGTTTATCACCCGCGAAGAAGCTATTCGTCACGTTCGTGCGTGGATTGGCTTTGATG - 18240
      -  I  C  L  S  P  A  K  K  L  F  V  T  F  V  R  G  L  A  L  M
      -  Y  V  V  Y  H  P  R  R  S  Y  S  S  R  S  C  V  D  W  L  *  C
      -     M  F  I  T  R  E  E  A  I  R  H  V  R  A  W  I  G  F  D  V
18241 - TAGAGGGCTGTCATGCAACTAGAGATGCTGTGGGTACTAACCTACCTCTCCAGCTAGGAT - 18300
      -  *  R  A  V  M  Q  L  E  M  L  W  V  L  T  Y  L  S  S  *  D
      -  R  G  L  S  C  N  *  R  C  C  G  Y  *  P  T  S  P  A  R  I
      -     E  G  C  H  A  T  R  D  A  V  G  T  N  L  P  L  Q  L  G  F
18301 - TTTCTACAGGTGTTAACTTAGTAGCTGTACCGACTGGTTATGTTGACACTGAAAATAACA - 18360
      -  F  L  Q  V  L  T  *  *  L  Y  R  L  V  M  L  T  L  K  I  T
      -  F  Y  R  C  *  L  S  S  C  T  D  W  L  C  *  H  *  K  *  H
      -     S  T  G  V  N  L  V  A  V  P  T  G  Y  V  D  T  E  N  N  T
18361 - CAGAATTCACCAGAGTTAATGCAAAACCTCCACCAGGTGACCAGTTTAAACATCTTATAC - 18420
      -  Q  N  S  P  E  L  M  Q  N  L  H  Q  V  T  S  L  N  I  L  Y
      -  R  I  H  Q  S  *  C  K  T  S  T  R  *  P  V  *  T  S  Y  T
      -     E  F  T  R  V  N  A  K  P  P  P  G  D  Q  F  K  H  L  I  P
18421 - CACTCATGTATAAAGGCTTGCCCTGGAATGTAGTGCGTATTAAGATAGTACAAATGCTCA - 18480
      -  H  S  C  I  K  A  C  P  G  M  *  C  V  L  R  *  Y  K  C  S
      -  T  H  V  *  R  L  A  L  E  C  S  A  Y  *  D  S  T  N  A  Q
      -     L  M  Y  K  G  L  P  W  N  V  V  R  I  K  I  V  Q  M  L  S
```

FIG. 11 Con't

```
18481 - GTGATACACTGAAAGGATTGTCAGACAGAGTCGTGTTCGTCCTTTGGGCGCATGGCTTTG - 18540
      - V  I  H  *  K  D  C  Q  T  E  S  C  S  S  F  G  R  M  A  L
      - *  Y  T  E  R  I  V  R  Q  S  R  V  R  P  L  G  A  W  L  *
      -   D  T  L  K  G  L  S  D  R  V  V  F  V  L  W  A  H  G  F  E
18541 - AGCTTACATCAATGAAGTACTTTGTCAAGATTGGACCTGAAAGAACGTGTTGTCTGTGTG - 18600
      - S  L  H  Q  *  S  T  L  S  R  L  D  L  K  E  R  V  V  C  V
      - A  Y  I  N  E  V  L  C  Q  D  W  T  *  K  N  V  L  S  V  *
      -   L  T  S  M  K  Y  F  V  K  I  G  P  E  R  T  C  C  L  C  D
18601 - ACAAACGTGCAACTTGCTTTTCTACTTCATCAGATACTTATGCCTGCTGGAATCATTCTG - 18660
      - T  N  V  Q  L  A  F  L  L  H  Q  I  L  M  P  A  G  I  I  L
      - Q  T  C  N  L  L  F  Y  F  I  R  Y  L  C  L  L  E  S  F  C
      -   K  R  A  T  C  F  S  T  S  S  D  T  Y  A  C  W  N  H  S  V
18661 - TGGGTTTTGACTATGTCTATAACCCATTTATGATTGATGTTCAGCAGTGGGGCTTTACGG - 18720
      - W  V  L  T  M  S  I  T  H  L  *  L  M  F  S  S  G  A  L  R
      - G  F  *  L  C  L  *  P  I  Y  D  *  C  S  A  V  G  L  Y  G
      -   G  F  D  Y  V  Y  N  P  F  M  I  D  V  Q  Q  W  G  F  T  G
18721 - GTAACCTTCAGAGTAACCATGACCAACATTGCCAGGTACATGGAAATGCACATGTGGCTA - 18780
      - V  T  F  R  V  T  M  T  N  I  A  R  Y  M  E  M  H  M  W  L
      - *  P  S  E  *  P  *  P  T  L  P  G  T  W  K  C  T  C  G  *
      -   N  L  Q  S  N  H  D  Q  H  C  Q  V  H  G  N  A  H  V  A  S
18781 - GTTGTGATGCTATCATGACTAGATGTTTAGCAGTCCATGAGTGCTTTGTTAAGCGCGTTG - 18840
      - V  V  M  L  S  *  L  D  V  *  Q  S  M  S  A  L  L  S  A  L
      - L  *  C  Y  H  D  *  M  F  S  S  P  *  V  L  C  *  A  R  *
      -   C  D  A  I  M  T  R  C  L  A  V  H  E  C  F  V  K  R  V  D
18841 - ATTGGTCTGTTGAATACCCTATTATAGGAGATGAACTGAGGGTTAATTCTGCTTGCAGAA - 18900
      - I  G  L  L  N  T  L  L  *  E  M  N  *  G  L  I  L  L  A  E
      - L  V  C  *  I  P  Y  Y  R  R  *  T  E  G  *  F  C  L  Q  K
      -   W  S  V  E  Y  P  I  I  G  D  E  L  R  V  N  S  A  C  R  K
18901 - AAGTACAACACATGGTTGTGAAGTCTGCATTGCTTGCTGATAAGTTTCCAGTTCTTCATG - 18960
      - K  Y  N  T  W  L  *  S  L  H  C  L  L  I  S  F  Q  F  F  M
      - S  T  T  H  G  C  E  V  C  I  A  C  *  *  V  S  S  S  S  *
      -   V  Q  H  M  V  V  K  S  A  L  L  A  D  K  F  P  V  L  H  D
18961 - ACATTGGAAATCCAAAGGCTATCAAGTGTGTGCCTCAGGCTGAAGTAGAATGGAAGTTCT - 19020
      - T  L  E  I  Q  R  L  S  S  V  C  L  R  L  K  *  N  G  S  S
      - H  W  K  S  K  G  Y  Q  V  C  A  S  G  *  S  R  M  E  V  L
      -   I  G  N  P  K  A  I  K  C  V  P  Q  A  E  V  E  W  K  F  Y
19021 - ACGATGCTCAGCCATGTAGTGACAAAGCTTACAAAATAGAGGAACTCTTCTATTCTTATG - 19080
      - T  M  L  S  H  V  V  T  K  L  T  K  *  R  N  S  S  I  L  M
      - R  C  S  A  M  *  *  Q  S  L  Q  N  R  G  T  L  L  F  L  C
      -   D  A  Q  P  C  S  D  K  A  Y  K  I  E  E  L  F  Y  S  Y  A
19081 - CTACACATCACGATAAATTCACTGATGGTGTTTGTTTGTTTTGGAATTGTAACGTTGATC - 19140
      - L  H  I  T  I  N  S  L  M  V  F  V  C  F  G  I  V  T  L  I
      - Y  T  S  R  *  I  H  *  W  C  L  F  V  L  E  L  *  R  *  S
      -   T  H  H  D  K  F  T  D  G  V  C  L  F  W  N  C  N  V  D  R
19141 - GTTACCCAGCCAATGCAATTGTGTGTAGGTTTGACACAAGAGTCTTGTCAAACTTGAACT - 19200
      - V  T  Q  P  M  Q  L  C  V  G  L  T  Q  E  S  C  Q  T  *  T
      - L  P  S  Q  C  N  C  V  *  V  *  H  K  S  L  V  K  L  E  L
      -   Y  P  A  N  A  I  V  C  R  F  D  T  R  V  L  S  N  L  N  L
19201 - TACCAGGCTGTGATGGTGGTAGTTTGTATGTGAATAAGCATGCATTCCACACTCCAGCTT - 19260
      - Y  Q  A  V  M  V  V  V  C  M  *  I  S  M  H  S  T  L  Q  L
      - T  R  L  *  W  W  *  F  V  C  E  *  A  C  I  P  H  S  S  F
      -   P  G  C  D  G  G  S  L  Y  V  N  K  H  A  F  H  T  P  A  F
19261 - TCGATAAAAGTGCATTTACTAATTTAAAGCAATTGCCTTTCTTTTACTATTCTGATAGTC - 19320
      - S  I  K  V  H  L  L  I  *  S  N  C  L  S  F  T  I  L  I  V
      - R  *  K  C  I  Y  *  F  K  A  I  A  F  L  L  L  F  *  *  S
      -   D  K  S  A  F  T  N  L  K  Q  L  P  F  F  Y  Y  S  D  S  P
```

FIG. 11 Con't

```
19321 - CTTGTGAGTCTCATGGCAAACAAGTAGTGTCGGATATTGATTATGTTCCACTCAAATCTG - 19380
      - L  V  S  L  M  A  N  K  *  C  R  I  L  I  M  F  H  S  N  L
      - L  *  V  S  W  Q  T  S  S  V  G  Y  *  L  C  S  T  Q  I  C
      -    C  E  S  H  G  K  Q  V  V  S  D  I  D  Y  V  P  L  K  S  A
19381 - CTACGTGTATTACACGATGCAATTTAGGTGGTGCTGTTTGCAGACACCATGCAAATGAGT - 19440
      - L  R  V  L  H  D  A  I  *  V  V  L  F  A  D  T  M  Q  M  S
      - Y  V  V  Y  Y  T  M  Q  F  R  W  C  C  L  Q  T  P  C  K  *  V
      -    T  C  I  T  R  C  N  L  G  G  A  V  C  R  H  H  A  N  E  Y
19441 - ACCGACAGTACTTGGATGCATATAATATGATGATTTCTGCTGGATTTAGCCTATGGATTT - 19500
      - T  D  S  T  W  M  H  I  I  *  *  F  L  L  D  L  A  Y  G  F
      - P  T  V  L  G  C  I  *  Y  D  D  F  C  W  I  *  P  M  D  L
      -    R  Q  Y  L  D  A  Y  N  M  M  I  S  A  G  F  S  L  W  I  Y
19501 - ACAAACAATTTGATACTTATAACCTGTGGAATACATTTACCAGGTTACAGAGTTTAGAAA - 19560
      - T  N  N  L  I  L  I  T  C  G  I  H  L  P  G  Y  R  V  *  K
      - Q  T  I  *  Y  L  *  P  V  E  Y  I  Y  Q  V  T  E  F  R  K
      -    K  Q  F  D  T  Y  N  L  W  N  T  F  T  R  L  Q  S  L  E  N
19561 - ATGTGGCTTATAATGTTGTTAATAAAGGACACTTTGATGGACACGCCGGCGAAGCACCTG - 19620
      - M  W  L  I  M  L  L  I  K  D  T  L  M  D  T  P  A  K  H  L
      - C  G  L  *  C  C  *  *  R  T  L  *  W  T  R  R  R  S  T  C
      -    V  A  Y  N  V  V  N  K  G  H  F  D  G  H  A  G  E  A  P  V
19621 - TTTCCATCATTAATAATGCTGTTTACACAAAGGTAGATGGTATTGATGTGGAGATCTTTG - 19680
      - F  P  S  L  I  M  L  F  T  Q  R  *  M  V  L  M  W  R  S  L
      - F  H  H  *  *  C  C  L  H  K  G  R  W  Y  *  C  G  D  L  *
      -    S  I  I  N  N  A  V  Y  T  K  V  D  G  I  D  V  E  I  F  E
19681 - AAAATAAGACAACACTTCCTGTTAATGTTGCATTTGAGCTTTGGGCTAAGCGTAACATTA - 19740
      - K  I  R  Q  H  F  L  L  M  L  H  L  S  F  G  L  S  V  T  L
      - K  *  D  N  T  S  C  *  C  C  I  *  A  L  G  *  A  *  H  *
      -    N  K  T  T  L  P  V  N  V  A  F  E  L  W  A  K  R  N  I  K
19741 - AACCAGTGCCAGAGATTAAGATACTCAATAATTTGGGTGTTGATATCGCTGCTAATACTG - 19800
      - N  Q  C  Q  R  L  R  Y  S  I  I  W  V  L  I  S  L  L  I  L
      - T  S  A  R  D  *  D  T  Q  *  F  G  C  *  Y  R  C  *  Y  C
      -    P  V  P  E  I  K  I  L  N  N  L  G  V  D  I  A  A  N  T  V
19801 - TAATCTGGGACTACAAAAGAGAAGCCCCAGCACATGTATCTACAATAGGTGTCTGCACAA - 19860
      - *  S  G  T  T  K  E  K  P  Q  H  M  Y  L  Q  *  V  S  A  Q
      - N  L  G  L  Q  K  R  S  P  S  T  C  I  Y  N  R  C  L  H  N
      -    I  W  D  Y  K  R  E  A  P  A  H  V  S  T  I  G  V  C  T  M
19861 - TGACTGACATTGCCAAGAAACCTACTGAGAGTGCTTGTTCTTCACTTACTGTCTTGTTTG - 19920
      - *  L  T  L  P  R  N  L  L  R  V  L  V  L  H  L  L  S  C  L
      - D  *  H  C  Q  E  T  Y  *  E  C  L  F  F  T  Y  C  L  V  *
      -    T  D  I  A  K  K  P  T  E  S  A  C  S  S  L  T  V  L  F  D
19921 - ATGGTAGAGTGGAAGGACAGGTAGACCTTTTTAGAAACGCCCGTAATGGTGTTTTAATAA - 19980
      - M  V  E  W  K  D  R  *  T  F  L  E  T  P  V  M  V  F  *  *
      - W  *  S  G  R  T  G  R  P  F  *  K  R  P  *  W  C  F  N  N
      -    G  R  V  E  G  Q  V  D  L  F  R  N  A  R  N  G  V  L  I  T
19981 - CAGAAGGTTCAGTCAAAGGTCTAACACCTTCAAAGGGACCAGCACAAGCTAGCGTCAATG - 20040
      - Q  K  V  Q  S  K  V  *  H  L  Q  R  D  Q  H  K  L  A  S  M
      - R  R  F  S  Q  R  S  N  T  F  K  G  T  S  T  S  *  R  Q  W
      -    E  G  S  V  K  G  L  T  P  S  K  G  P  A  Q  A  S  V  N  G
20041 - GAGTCACATTAATTGGAGAATCAGTAAAAACACAGTTTAACTACTTTAAGAAAGTAGACG - 20100
      - E  S  H  *  L  E  N  Q  *  K  H  S  L  T  T  L  R  K  *  T
      - S  H  I  N  W  R  I  S  K  N  T  V  *  L  L  *  E  S  R  R
      -    V  T  L  I  G  E  S  V  K  T  Q  F  N  Y  F  K  K  V  D  G
20101 - GCATTATTCAACAGTTGCCTGAAACCTACTTTACTCAGAGCAGAGACTTAGAGGATTTTA - 20160
      - A  L  F  N  S  C  L  K  P  T  L  L  R  A  E  T  *  R  I  L
      - H  Y  S  T  V  A  *  N  L  L  Y  S  E  Q  R  L  R  G  F  *
      -    I  I  Q  Q  L  P  E  T  Y  F  T  Q  S  R  D  L  E  D  F  K
```

FIG. 11 Con't

```
20161 - AGCCCAGATCACAAATGGAAACTGACTTTCTCGAGCTCGCTATGGATGAATTCATACAGC - 20220
      - S  P  D  H  K  W  K  L  T  F  S  S  S  L  W  M  N  S  Y  S
      -  A  Q  I  T  N  G  N  *  L  S  R  A  R  Y  G  *  I  H  T  A
      -   P  R  S  Q  M  E  T  D  F  L  E  L  A  M  D  E  F  I  Q  R
20221 - GATATAAGCTCGAGGGCTATGCCTTCGAACACATCGTTTATGGAGATTTCAGTCATGGAC - 20280
      - D  I  S  S  R  A  M  P  S  N  T  S  F  M  E  I  S  V  M  D
      -  I  *  A  R  G  L  C  L  R  T  H  R  L  W  R  F  Q  S  W  T
      -   Y  K  L  E  G  Y  A  F  E  H  I  V  Y  G  D  F  S  H  G  Q
20281 - AACTTGGCGGTCTTCATTTAATGATAGGCTTAGCCAAGCGCTCACAAGATTCACCACTTA - 20340
      - N  L  A  V  F  I  *  *  *  A  *  P  S  A  H  K  I  H  H  L
      -  T  W  R  S  S  F  N  D  R  L  S  Q  A  L  T  R  F  T  T  *
      -   L  G  G  L  H  L  M  I  G  L  A  K  R  S  Q  D  S  P  L  K
20341 - AATTAGAGGATTTTATCCCTATGGACAGCACAGTGAAAAATTACTTCATAACAGATGCGC - 20400
      - N  *  R  I  L  S  L  W  T  A  Q  *  K  I  T  S  *  Q  M  R
      -  I  R  G  F  Y  P  Y  G  Q  H  S  E  K  L  L  H  N  R  C  A
      -   L  E  D  F  I  P  M  D  S  T  V  K  N  Y  F  I  T  D  A  Q
20401 - AAACAGGTTCATCAAAATGTGTGTGTTCTGTGATTGATCTTTTACTTGATGACTTTGTCG - 20460
      - K  Q  V  H  Q  N  V  C  V  L  *  L  I  F  Y  L  M  T  L  S
      -  N  R  F  I  K  M  C  V  F  C  D  *  S  F  T  *  *  L  C  R
      -   T  G  S  S  K  C  V  C  S  V  I  D  L  L  L  D  D  F  V  E
20461 - AGATAATAAAGTCACAAGATTTGTCAGTGATTTCAAAAGTGGTCAAGGTTACAATTGACT - 20520
      - R  *  *  S  H  K  I  C  Q  *  F  Q  K  W  S  R  L  Q  L  T
      -  D  N  K  V  T  R  F  V  S  D  F  K  S  G  Q  G  Y  N  *  L
      -   I  I  K  S  Q  D  L  S  V  I  S  K  V  V  K  V  T  I  D  Y
20521 - ATGCTGAAATTTCATTCATGCTTTGGTGTAAGGATGGACATGTTGAAACCTTCTACCCAA - 20580
      - M  L  K  F  H  S  C  F  G  V  R  M  D  M  L  K  P  S  T  Q
      -  C  *  N  F  I  H  A  L  V  *  G  W  T  C  *  N  L  L  P  K
      -   A  E  I  S  F  M  L  W  C  K  D  G  H  V  E  T  F  Y  P  K
20581 - AACTACAAGCAAGTCAAGCGTGGCAACCAGGTGTTGCGATGCCTAACTTGTACAAGATGC - 20640
      - N  Y  K  Q  V  K  R  G  N  Q  V  L  R  C  L  T  C  T  R  C
      -  T  T  S  K  S  S  V  A  T  R  C  C  D  A  *  L  V  Q  D  A
      -   L  Q  A  S  Q  A  W  Q  P  G  V  A  M  P  N  L  Y  K  M  Q
20641 - AAAGAATGCTTCTTGAAAAGTGTGACCTTCAGAATTATGGTGAAAATGCTGTTATACCAA - 20700
      - K  E  C  F  L  K  S  V  T  F  R  I  M  V  K  M  L  L  Y  Q
      -  K  N  A  S  *  K  V  *  P  S  E  L  W  *  K  C  C  Y  T  K
      -   R  M  L  L  E  K  C  D  L  Q  N  Y  G  E  N  A  V  I  P  K
20701 - AAGGAATAATGATGAATGTCGCAAAGTATACTCAACTGTGTCAATACTTAAATACACTTA - 20760
      - K  E  *  *  *  M  S  Q  S  I  L  N  C  V  N  T  *  I  H  L
      -  R  N  N  D  E  C  R  K  V  Y  S  T  V  S  I  L  K  Y  T  Y
      -   G  I  M  M  N  V  A  K  Y  T  Q  L  C  Q  Y  L  N  T  L  T
20761 - CTTTAGCTGTACCCTACAACATGAGAGTTATTCACTTTGGTGCTGGCTCTGATAAAGGAG - 20820
      - L  *  L  Y  P  T  T  *  E  L  F  T  L  V  L  A  L  I  K  E
      -  F  S  C  T  L  Q  H  E  S  Y  S  L  W  C  W  L  *  *  R  S
      -   L  A  V  P  Y  N  M  R  V  I  H  F  G  A  G  S  D  K  G  V
20821 - TTGCACCAGGTACAGCTGTGCTCAGACAATGGTTGCCAACTGGCACACTACTTGTCGATT - 20880
      - L  H  Q  V  Q  L  C  S  D  N  G  C  Q  L  A  H  Y  L  S  I
      -  C  T  R  Y  S  C  A  Q  T  M  V  A  N  W  H  T  T  C  R  F
      -   A  P  G  T  A  V  L  R  Q  W  L  P  T  G  T  L  L  V  D  S
20881 - CAGATCTTAATGACTTCGTCTCCGACGCAGATTCTACTTTAATTGGAGACTGTGCAACAG - 20940
      - Q  I  L  M  T  S  S  P  T  Q  I  L  L  *  L  E  T  V  Q  Q
      -  R  S  *  *  L  R  L  R  R  R  F  Y  F  N  W  R  L  C  N  S
      -   D  L  N  D  F  V  S  D  A  D  S  T  L  I  G  D  C  A  T  V
20941 - TACATACGGCTAATAAATGGACCTTATTATTAGCGATATGTATGACCCTAGGACCAAAC - 21000
      - Y  I  R  L  I  N  G  T  L  L  L  A  I  C  M  T  L  G  P  N
      -  T  Y  G  *  *  M  G  P  Y  Y  *  R  Y  V  *  P  *  D  Q  T
      -   H  T  A  N  K  W  D  L  I  I  S  D  M  Y  D  P  R  T  K  H
```

FIG. 11 Con't

```
21001 - ATGTGACAAAAGAGAATGACTCTAAAGAAGGGTTTTTCACTTATCTGTGTGGATTTATAA - 21060
       - M  *  Q  K  R  M  T  L  K  K  G  F  S  L  I  C  V  D  L  *
       -  C  D  K  R  E  *  L  *  R  R  V  F  H  L  S  V  W  I  Y  K
       -   V  T  K  E  N  D  S  K  E  G  F  F  T  Y  L  C  G  F  I  K
21061 - AGCAAAAACTAGCCCTGGGTGGTTCTATAGCTGTAAAGATAACAGAGCATTCTTGGAATG - 21120
       - S  K  N  *  P  W  V  V  L  *  L  *  R  *  Q  S  I  L  G  M
       -  A  K  T  S  P  G  W  F  Y  S  C  K  D  N  R  A  F  L  E  C
       -   Q  K  L  A  L  G  G  S  I  A  V  K  I  T  E  H  S  W  N  A
21121 - CTGACCTTTACAAGCTTATGGGCCATTTCTCATGGTGGACAGCTTTTGTTACAAATGTAA - 21180
       - L  T  F  T  S  L  W  A  I  S  H  G  G  Q  L  L  L  Q  M  *
       -  *  P  L  Q  A  Y  G  P  F  L  M  V  D  S  F  C  Y  K  C  K
       -   D  L  Y  K  L  M  G  H  F  S  W  W  T  A  F  V  T  N  V  N
21181 - ATGCATCATCATCGGAAGCATTTTTAATTGGGGCTAACTATCTTGGCAAGCCGAAGGAAC - 21240
       - M  H  H  H  R  K  H  F  *  L  G  L  T  I  L  A  S  R  R  N
       -  C  I  I  I  G  S  I  F  N  W  G  *  L  S  W  Q  A  E  G  T
       -   A  S  S  S  E  A  F  L  I  G  A  N  Y  L  G  K  P  K  E  Q
21241 - AAATTGATGGCTATACCATGCATGCTAACTACATTTCTGGAGGAACACAAATCCTATCC - 21300
       - K  L  M  A  I  P  C  M  L  T  T  F  S  G  G  T  Q  I  L  S
       -  N  *  W  L  Y  H  A  C  *  L  H  F  L  E  E  H  K  S  Y  P
       -   I  D  G  Y  T  M  H  A  N  Y  I  F  W  R  N  T  N  P  I  Q
21301 - AGTTGTCTTCCTATTCACTCTTTGACATGAGCAAATTTCCTCTTAAATTAAGAGGAACTG - 21360
       - S  C  L  P  I  H  S  L  T  *  A  N  F  L  L  N  *  E  E  L
       -  V  V  F  L  F  T  L  *  H  E  Q  I  S  S  *  I  K  R  N  C
       -   L  S  S  Y  S  L  F  D  M  S  K  F  P  L  K  L  R  G  T  A
21361 - CTGTAATGTCTCTTAAGGAGAATCAAATCAATGATATGATTTATTCTCTTCTGGAAAAAG - 21420
       - L  *  C  L  L  R  R  I  K  S  M  I  *  F  I  L  F  W  K  K
       -  C  N  V  S  *  G  E  S  N  Q  *  Y  D  L  F  S  S  G  K  R
       -   V  M  S  L  K  E  N  Q  I  N  D  M  I  Y  S  L  L  E  K  G
21421 - GTAGGCTTATCATTAGAGAAAACAACAGAGTTGTGGTTTCAAGTGATATTCTTGTTAACA - 21480
       - V  G  L  S  L  E  K  T  T  E  L  W  F  Q  V  I  F  L  L  T
       -  *  A  Y  H  *  R  K  Q  Q  S  C  G  F  K  *  Y  S  C  *  Q
       -   R  L  I  I  R  E  N  N  R  V  V  V  S  S  D  I  L  V  N  N
21481 - ACTAAACGAACATGTTTATTTTCTTATTATTTCTTACTCTCACTAGTGGTAGTGACCTTG - 21540
       - T  K  R  T  C  L  F  S  Y  Y  F  L  L  S  L  V  V  V  T  L
       -  L  N  E  H  V  Y  F  L  I  I  S  Y  S  H  *  W  *  *  P  *
       -   *  T  N  M  F  I  F  L  L  F  L  T  L  T  S  G  S  D  L  D
21541 - ACCGGTGCACCACTTTTGATGATGTTCAAGCTCCTAATTACACTCAACATACTTCATCTA - 21600
       - T  G  A  P  L  L  M  M  F  K  L  L  I  T  L  N  I  L  H  L
       -  P  V  H  H  F  *  *  C  S  S  S  *  L  H  S  T  Y  F  I  Y
       -   R  C  T  T  F  D  D  V  Q  A  P  N  Y  T  Q  H  T  S  S  M
21601 - TGAGGGGGGTTTACTATCCTGATGAAATTTTTAGATCAGACACTCTTTATTTAACTCAGG - 21660
       - *  G  G  F  T  I  L  M  K  F  L  D  Q  T  L  F  I  *  L  R
       -  E  G  G  L  L  S  *  *  N  F  *  I  R  H  S  L  F  N  S  G
       -   R  G  V  Y  Y  P  D  E  I  F  R  S  D  T  L  Y  L  T  Q  D
21661 - ATTTATTTCTTCCATTTTATTCTAATGTTACAGGGTTTCATACTATTAATCATACGTTTG - 21720
       - I  Y  F  F  H  F  I  L  M  L  Q  G  F  I  L  L  I  I  R  L
       -  F  I  S  S  I  L  F  *  C  Y  R  V  S  Y  Y  *  S  Y  V  W
       -   L  F  L  P  F  Y  S  N  V  T  G  F  H  T  I  N  H  T  F  G
21721 - GCAACCCTGTCATACCTTTTAAGGATGGTATTTATTTTGCTGCCACAGAGAAATCAAATG - 21780
       - A  T  L  S  Y  L  L  R  M  V  F  I  L  L  P  Q  R  N  Q  M
       -  Q  P  C  H  T  F  *  G  W  Y  L  F  C  C  H  R  E  I  K  C
       -   N  P  V  I  P  F  K  D  G  I  Y  F  A  A  T  E  K  S  N  V
21781 - TTGTCCGTGGTTGGGTTTTTGGTTCTACCATGAACAACAAGTCACAGTCGGTGATTATTA - 21840
       - L  S  V  V  G  F  L  V  L  P  *  T  T  S  H  S  R  *  L  L
       -  C  P  W  L  G  F  W  F  Y  H  E  Q  Q  V  T  V  G  D  Y  Y
       -   V  R  G  W  V  F  G  S  T  M  N  N  K  S  Q  S  V  I  I  I
```

FIG. 11 Con't

```
21841 - TTAACAATTCTACTAATGTTGTTATACGAGCATGTAACTTTGAATTGTGTGACAACCCTT - 21900
      - L  T  I  L  L  M  L  L  Y  E  H  V  T  L  N  C  V  T  T  L
      - *  Q  F  Y  *  C  C  Y  T  S  M  *  L  *  I  V  *  Q  P  F
      - N  N  S  T  N  V  V  I  R  A  C  N  F  E  L  C  D  N  P  F
21901 - TCTTTGCTGTTTCTAAACCCATGGGTACACAGACACATACTATGATATTCGATAATGCAT - 21960
      - S  L  L  F  L  N  P  W  V  H  R  H  I  L  *  Y  S  I  M  H
      - L  C  C  F  *  T  H  G  Y  T  D  T  Y  Y  D  I  R  *  C  I
      - F  A  V  S  K  P  M  G  T  Q  T  H  T  M  I  F  D  N  A  F
21961 - TTAATTGCACTTTCGAGTACATATCTGATGCCTTTTCGCTTGATGTTTCAGAAAAGTCAG - 22020
      - L  I  A  L  S  S  T  Y  L  M  P  F  R  L  M  F  Q  K  S  Q
      - *  L  H  F  R  V  H  I  *  C  L  F  A  *  C  F  R  K  V  R
      - N  C  T  F  E  Y  I  S  D  A  F  S  L  D  V  S  E  K  S  G
22021 - GTAATTTTAAACACTTACGAGAGTTTGTGTTTAAAAATAAAGATGGGTTTCTCTATGTTT - 22080
      - V  I  L  N  T  Y  E  S  L  C  L  K  I  K  M  G  F  S  M  F
      - *  F  *  T  L  T  R  V  C  V  *  K  *  R  W  V  S  L  C  L
      - N  F  K  H  L  R  E  F  V  F  K  N  K  D  G  F  L  Y  V  Y
22081 - ATAAGGGCTATCAACCTATAGATGTAGTTCGTGATCTACCTTCTGGTTTTAACACTTTGA - 22140
      - I  R  A  I  N  L  *  M  *  F  V  I  Y  L  L  V  L  T  L  *
      - *  G  L  S  T  Y  R  C  S  S  *  S  T  F  W  F  *  H  F  E
      - K  G  Y  Q  P  I  D  V  V  R  D  L  P  S  G  F  N  T  L  K
22141 - AACCTATTTTTAAGTTGCCTCTTGGTATTAACATTACAAATTTTAGAGCCATTCTTACAG - 22200
      - N  L  F  L  S  C  L  L  V  L  T  L  Q  I  L  E  P  F  L  Q
      - T  Y  F  *  V  A  S  W  Y  *  H  Y  K  F  *  S  H  S  Y  S
      - P  I  F  K  L  P  L  G  I  N  I  T  N  F  R  A  I  L  T  A
22201 - CCTTTTCACCTGCTCAAGACATTTGGGGCACGTCAGCTGCAGCCTATTTTGTTGGCTATT - 22260
      - P  F  H  L  L  K  T  F  G  A  R  Q  L  Q  P  I  L  L  A  I
      - L  F  T  C  S  R  H  L  G  H  V  S  C  S  L  F  C  W  L  F
      - F  S  P  A  Q  D  I  W  G  T  S  A  A  A  Y  F  V  G  Y  L
22261 - TAAAGCCAACTACATTTATGCTCAAGTATGATGAAAATGGTACAATCACAGATGCTGTTG - 22320
      - *  S  Q  L  H  L  C  S  S  M  M  K  M  V  Q  S  Q  M  L  L
      - K  A  N  Y  I  Y  A  Q  V  *  *  K  W  Y  N  H  R  C  C  *
      - K  P  T  T  F  M  L  K  Y  D  E  N  G  T  I  T  D  A  V  D
22321 - ATTGTTCTCAAAATCCACTTGCTGAACTCAAATGCTCTGTTAAGAGCTTTGAGATTGACA - 22380
      - I  V  L  K  I  H  L  L  N  S  N  A  L  L  R  A  L  R  L  T
      - L  F  S  K  S  T  C  *  T  Q  M  L  C  *  E  L  *  D  *  Q
      - C  S  Q  N  P  L  A  E  L  K  C  S  V  K  S  F  E  I  D  K
22381 - AAGGAATTTACCAGACCTCTAATTTCAGGGTTGTTCCCTCAGGAGATGTTGTGAGATTCC - 22440
      - K  E  F  T  R  P  L  I  S  G  L  F  P  Q  E  M  L  *  D  S
      - R  N  L  P  D  L  *  F  Q  G  C  S  L  R  R  C  C  E  I  P
      - G  I  Y  Q  T  S  N  F  R  V  V  P  S  G  D  V  V  R  F  P
22441 - CTAATATTACAAACTTGTGTCCTTTTGGAGAGGTTTTTAATGCTACTAAATTCCCTTCTG - 22500
      - L  I  L  Q  T  C  V  L  L  E  R  F  L  M  L  L  N  S  L  L
      - *  Y  Y  K  L  V  S  F  W  R  G  F  *  C  Y  *  I  P  F  C
      - N  I  T  N  L  C  P  F  G  E  V  F  N  A  T  K  F  P  S  V
22501 - TCTATGCATGGGAGAGAAAAAAAATTTCTAATTGTGTTGCTGATTACTCTGTGCTCTACA - 22560
      - S  M  H  G  R  E  K  K  F  L  I  V  L  L  I  T  L  C  S  T
      - L  C  M  G  E  K  K  N  F  *  L  C  C  *  L  L  C  A  L  Q
      - Y  A  W  E  R  K  K  I  S  N  C  V  A  D  Y  S  V  L  Y  N
22561 - ACTCAACATTTTTTTCAACCTTTAAGTGCTATGGCGTTTCTGCCACTAAGTTGAATGATC - 22620
      - T  Q  H  F  F  Q  P  L  S  A  M  A  F  L  P  L  S  *  M  I
      - L  N  I  F  F  N  L  *  V  L  W  R  F  C  H  *  V  E  *  S
      - S  T  F  F  S  T  F  K  C  Y  G  V  S  A  T  K  L  N  D  L
22621 - TTTGCTTCTCCAATGTCTATGCAGATTCTTTTGTAGTCAAGGGAGATGATGTAAGACAAA - 22680
      - F  A  S  P  M  S  M  Q  I  L  L  *  S  R  E  M  M  *  D  K
      - L  L  L  Q  C  L  C  R  F  F  C  S  Q  G  R  *  C  K  T  N
      - C  F  S  N  V  Y  A  D  S  F  V  V  K  G  D  D  V  R  Q  I
```

FIG. 11 Con't

```
22681 - TAGCGCCAGGACAAACTGGTGTTATTGCTGATTATAATTATAAATTGCCAGATGATTTCA - 22740
      - *  R  Q  D  K  L  V  L  L  L  I  I  I  N  C  Q  M  I  S
      -  S  A  R  T  N  W  C  Y  C  *  L  *  L  *  I  A  R  *  F  H
      -   A  P  G  Q  T  G  V  I  A  D  Y  N  Y  K  L  P  D  D  F  M
22741 - TGGGTTGTGTCCTTGCTTGGAATACTAGGAACATTGATGCTACTTCAACTGGTAATTATA - 22800
      -  W  V  V  S  L  L  G  I  L  G  T  L  M  L  L  Q  L  V  I  I
      -   G  L  C  P  C  L  E  Y  *  E  H  ·  *  C  Y  F  N  W  *  L  *
      -    G  C  V  L  A  W  N  T  R  N  I  D  A  T  S  T  G  N  Y  N
22801 - ATTATAAATATAGGTATCTTAGACATGGCAAGCTTAGGCCCTTTGAGAGAGACATATCTA - 22860
      -  I  I  N  I  G  I  L  D  M  A  S  L  G  P  L  R  E  T  Y  L
      -   L  *  I  *  V  S  *  T  W  Q  A  *  A  L  *  E  R  H  I  *
      -    Y  K  Y  R  Y  L  R  H  G  K  L  R  P  F  E  R  D  I  S  N
22861 - ATGTGCCTTTCTCCCCTGATGGCAAACCTTGCACCCCACCTGCTCTTAATTGTTATTGGC - 22920
      -  M  C  L  S  P  L  M  A  N  L  A  P  H  L  L  L  I  V  I  G
      -   C  A  F  L  P  *  W  Q  T  L  H  P  T  C  S  *  L  L  L  A
      -    V  P  F  S  P  D  G  K  P  C  T  P  P  A  L  N  C  Y  W  P
22921 - CATTAAATGATTATGGTTTTTACACCACTACTGGCATTGGCTACCAACCTTACAGAGTTG - 22980
      -  H  *  M  I  M  V  F  T  P  L  L  A  L  A  T  N  L  T  E  L
      -   I  K  *  L  W  F  L  H  H  Y  W  H  W  L  P  T  L  Q  S  C
      -    L  N  D  Y  G  F  Y  T  T  T  G  I  G  Y  Q  P  Y  R  V  V
22981 - TAGTACTTTCTTTTGAACTTTTAAATGCACCGGCCACGGTTTGTGGACCAAAATTATCCA - 23040
      -  *  Y  F  L  L  N  F  *  M  H  R  P  R  F  V  D  Q  N  Y  P
      -   S  T  F  F  *  T  F  K  C  T  G  H  G  L  W  T  K  I  I  H
      -    V  L  S  F  E  L  L  N  A  P  A  T  V  C  G  P  K  L  S  T
23041 - CTGACCTTATTAAGAACCAGTGTGTCAATTTTAATTTTAATGGACTCACTGGTACTGGTG - 23100
      -  L  T  L  L  R  T  S  V  S  I  L  I  L  M  D  S  L  V  L  V
      -   *  P  Y  *  E  P  V  C  Q  F  *  F  *  W  T  H  W  Y  W  C
      -    D  L  I  K  N  Q  C  V  N  F  N  F  N  G  L  T  G  T  G  V
23101 - TGTTAACTCCTTCTTCAAAGAGATTTCAACCATTTCAACAATTTGGCCGTGATGTTTCTG - 23160
      -  C  *  L  L  L  Q  R  D  F  N  H  F  N  N  L  A  V  M  F  L
      -   V  N  S  F  F  K  E  I  S  T  I  S  T  I  W  P  *  C  F  *
      -    L  T  P  S  S  K  R  F  Q  P  F  Q  Q  F  G  R  D  V  S  D
23161 - ATTTCACTGATTCCGTTCGAGATCCTAAAACATCTGAAATATTAGACATTTCACCTTGCT - 23220
      -  I  S  L  I  P  F  E  I  L  K  H  L  K  Y  *  T  F  H  L  A
      -   F  H  *  F  R  S  R  S  *  N  I  *  N  I  R  H  F  T  L  L
      -    F  T  D  S  V  R  D  P  K  T  S  E  I  L  D  I  S  P  C  S
23221 - CTTTTGGGGGTGTAAGTGTAATTACACCTGGAACAAATGCTTCATCTGAAGTTGCTGTTC - 23280
      -  L  L  G  V  *  V  *  L  H  L  E  Q  M  L  H  L  K  L  L  F
      -   F  W  G  C  K  C  N  Y  T  W  N  K  C  F  I  *  S  C  C  S
      -    F  G  G  V  S  V  I  T  P  G  T  N  A  S  S  E  V  A  V  L
23281 - TATATCAAGATGTTAACTGCACTGATGTTTCTACAGCAATTCATGCAGATCAACTCACAC - 23340
      -  Y  I  K  M  L  T  A  L  M  F  L  Q  Q  F  M  Q  I  N  S  H
      -   I  S  R  C  *  L  H  *  C  F  Y  S  N  S  C  R  S  T  H  T
      -    Y  Q  D  V  N  C  T  D  V  S  T  A  I  H  A  D  Q  L  T  P
23341 - CAGCTTGGCGCATATATTCTACTGGAAACAATGTATTCCAGACTCAAGCAGGCTGTCTTA - 23400
      -  Q  L  G  A  Y  I  L  L  E  T  M  Y  S  R  L  K  Q  A  V  L
      -   S  L  A  H  I  F  Y  W  K  Q  C  I  P  D  S  S  R  L  S  Y
      -    A  W  R  I  Y  S  T  G  N  N  V  F  Q  T  Q  A  G  C  L  I
23401 - TAGGAGCTGAGCATGTCGACACTTCTTATGAGTGCGACATTCCTATTGGAGCTGGCATTT - 23460
      -  *  E  L  S  M  S  T  L  L  M  S  A  T  F  L  L  E  L  A  F
      -   R  S  *  A  C  R  H  F  L  *  V  R  H  S  Y  W  S  W  H  L
      -    G  A  E  H  V  D  T  S  Y  E  C  D  I  P  I  G  A  G  I  C
23461 - GTGCTAGTTACCATACAGTTTCTTTATTACGTAGTACTAGCCAAAAATCTATTGTGGCTT - 23520
      -  V  L  V  T  I  Q  F  L  Y  Y  V  V  L  A  K  N  L  L  W  L
      -   C  *  L  P  Y  S  F  F  I  T  *  Y  *  P  K  I  Y  C  G  L
      -    A  S  Y  H  T  V  S  L  L  R  S  T  S  Q  K  S  I  V  A  Y
```

FIG. 11 Con't

```
23521 - ATACTATGTCTTTAGGTGCTGATAGTTCAATTGCTTACTCTAATAACACCATTGCTATAC - 23580
       - I  L  C  L  *  V  L  I  V  Q  L  L  T  L  I  T  P  L  L  Y
       -  Y  Y  V  F  R  C  *  *  F  N  C  L  L  *  *  H  H  C  Y  T
       -   T  M  S  L  G  A  D  S  S  I  A  Y  S  N  N  T  I  A  I  P
23581 - CTACTAACTTTTCAATTAGCATTACTACAGAAGTAATGCCTGTTTCTATGGCTAAAACCT - 23640
       - L  L  T  F  Q  L  A  L  L  Q  K  *  C  L  F  L  W  L  K  P
       -  Y  *  L  F  N  *  H  Y  Y  R  S  N  A  C  F  Y  G  *  N  L
       -   T  N  F  S  I  S  I  T  T  E  V  M  P  V  S  M  A  K  T  S
23641 - CCGTAGATTGTAATATGTACATCTGCGGAGATTCTACTGAATGTGCTAATTTGCTTCTCC - 23700
       - P  *  I  V  I  C  T  S  A  E  I  L  L  N  V  L  I  C  F  S
       -  R  R  L  *  Y  V  H  L  R  R  F  Y  *  M  C  *  F  A  S  P
       -   V  D  C  N  M  Y  I  C  G  D  S  T  E  C  A  N  L  L  L  Q
23701 - AATATGGTAGCTTTTGCACACAACTAAATCGTGCACTCTCAGGTATTGCTGCTGAACAGG - 23760
       - N  M  V  A  F  A  H  N  *  I  V  H  S  Q  V  L  L  L  N  R
       -  I  W  *  L  L  H  T  T  K  S  C  T  L  R  Y  C  C  *  T  G
       -   Y  G  S  F  C  T  Q  L  N  R  A  L  S  G  I  A  A  E  Q  D
23761 - ATCGCAACACACGTGAAGTGTTCGCTCAAGTCAAACAAATGTACAAAACCCCAACTTTGA - 23820
       - I  A  T  H  V  K  C  S  L  K  S  N  K  C  T  K  P  Q  L  *
       -  S  Q  H  T  *  S  V  R  S  S  Q  T  N  V  Q  N  P  N  F  E
       -   R  N  T  R  E  V  F  A  Q  V  K  Q  M  Y  K  T  P  T  L  K
23821 - AATATTTTGGTGGTTTTAATTTTTCACAAATATTACCTGACCCTCTAAAGCCAACTAAGA - 23880
       - N  I  L  V  V  L  I  F  H  K  Y  Y  L  T  L  *  S  Q  L  R
       -  I  F  W  W  F  *  F  F  T  N  I  T  *  P  S  K  A  N  *  E
       -   Y  F  G  G  F  N  F  S  Q  I  L  P  D  P  L  K  P  T  K  R
23881 - GGTCTTTTATTGAGGACTTGCTCTTTAATAAGGTGACACTCGCTGATGCTGGCTTCATGA - 23940
       - G  L  L  L  R  T  C  S  L  I  R  *  H  S  L  M  L  A  S  *
       -  V  F  Y  *  G  L  A  L  *  *  G  D  T  R  *  C  W  L  H  E
       -   S  F  I  E  D  L  L  F  N  K  V  T  L  A  D  A  G  F  M  K
23941 - AGCAATATGGCGAATGCCTAGGTGATATTAATGCTAGAGATCTCATTTGTGCGCAGAAGT - 24000
       - S  N  M  A  N  A  *  V  I  L  M  L  E  I  S  F  V  R  R  S
       -  A  I  W  R  M  P  R  *  Y  *  C  *  R  S  H  L  C  A  E  V
       -   Q  Y  G  E  C  L  G  D  I  N  A  R  D  L  I  C  A  Q  K  F
24001 - TCAATGGACTTACAGTGTTGCCACCTCTGCTCACTGATGATATGATTGCTGCCTACACTG - 24060
       - S  M  D  L  Q  C  C  H  L  C  S  L  M  I  *  L  L  P  T  L
       -  Q  W  T  Y  S  V  A  T  S  A  H  *  *  Y  D  C  C  L  H  C
       -   N  G  L  T  V  L  P  P  L  L  T  D  D  M  I  A  A  Y  T  A
24061 - CTGCTCTAGTTAGTGGTACTGCCACTGCTGGATGGACATTTGGTGCTGGCGCTGCTCTTC - 24120
       - L  L  *  L  V  V  L  P  L  L  D  G  H  L  V  L  A  L  L  F
       -  C  S  S  *  W  Y  C  H  C  W  M  D  I  W  C  W  R  C  S  S
       -   A  L  V  S  G  T  A  T  A  G  W  T  F  G  A  G  A  A  L  Q
24121 - AAATACCTTTTGCTATGCAAATGGCATATAGGTTCAATGGCATTGGAGTTACCCAAAATG - 24180
       - K  Y  L  L  L  C  K  W  H  I  G  S  M  A  L  E  L  P  K  M
       -  N  T  F  C  Y  A  N  G  I  *  V  Q  W  H  W  S  Y  P  K  C
       -   I  P  F  A  M  Q  M  A  Y  R  F  N  G  I  G  V  T  Q  N  V
24181 - TTCTCTATGAGAACCAAAAACAAATCGCCAACCAATTTAACAAGGCGATTAGTCAAATTC - 24240
       - F  S  M  R  T  K  N  K  S  P  T  N  L  T  R  R  L  V  K  F
       -  S  L  *  E  P  K  T  N  R  Q  P  I  *  Q  G  D  *  S  N  S
       -   L  Y  E  N  Q  K  Q  I  A  N  Q  F  N  K  A  I  S  Q  I  Q
24241 - AAGAATCACTTACAACAACATCAACTGCATTGGGCAAGCTGCAAGACGTTGTTAACCAGA - 24300
       - K  N  H  L  Q  Q  H  Q  L  H  W  A  S  C  K  T  L  L  T  R
       -  R  I  T  Y  N  N  I  N  C  I  G  Q  A  A  R  R  C  *  P  E
       -   E  S  L  T  T  T  S  T  A  L  G  K  L  Q  D  V  V  N  Q  N
24301 - ATGCTCAAGCATTAAACACACTTGTTAAACAACTTAGCTCTAATTTTGGTGCAATTTCAA - 24360
       - M  L  K  H  *  T  H  L  L  N  N  L  A  L  I  L  V  Q  F  Q
       -  C  S  S  I  K  H  T  C  *  T  T  *  L  *  F  W  C  N  F  K
       -   A  Q  A  L  N  T  L  V  K  Q  L  S  S  N  F  G  A  I  S  S
```

FIG. 11 Con't

```
24361 - GTGTGCTAAATGATATCCTTTCGCGACTTGATAAAGTCGAGGCGGAGGTACAAATTGACA - 24420
      - V  C  *  M  I  S  F  R  D  L  I  K  S  R  R  R  Y  K  L  T
      -  C  A  K  *  Y  P  F  A  T  *  *  S  R  G  G  G  T  N  *  Q
      -   V  L  N  D  I  L  S  R  L  D  K  V  E  A  E  V  Q  I  D  R
24421 - GGTTAATTACAGGCAGACTTCAAAGCCTTCAAACCTATGTAACACAACAACTAATCAGGG - 24480
      - G  *  L  Q  A  D  F  K  A  F  K  P  M  *  H  N  N  *  S  G
      -  V  N  Y  R  Q  T  S  K  P  S  N  L  C  N  T  T  T  N  Q  G
      -   L  I  T  G  R  L  Q  S  L  Q  T  Y  V  T  Q  Q  L  I  R  A
24481 - CTGCTGAAATCAGGGCTTCTGCTAATCTTGCTGCTACTAAAATGTCTGAGTGTGTTCTTG - 24540
      - L  L  K  S  G  L  L  L  I  L  L  L  L  K  C  L  S  V  F  L
      -  C  *  N  Q  G  F  C  *  S  C  C  Y  *  N  V  *  V  C  S  W
      -   A  E  I  R  A  S  A  N  L  A  A  T  K  M  S  E  C  V  L  G
24541 - GACAATCAAAAGAGTTGACTTTTGTGGAAAGGGCTACCACCTTATGTCCTTCCCACAAG - 24600
      - D  N  Q  K  E  L  T  F  V  E  R  A  T  T  L  C  P  S  H  K
      -  T  I  K  K  S  *  L  L  W  K  G  L  P  P  Y  V  L  P  T  S
      -   Q  S  K  R  V  D  F  C  G  K  G  Y  H  L  M  S  F  P  Q  A
24601 - CAGCCCCGCATGGTGTTGTCTTCCTACATGTCACGTATGTGCCATCCCAGGAGAGGAACT - 24660
      - Q  P  R  M  V  L  S  S  Y  M  S  R  M  C  H  P  R  R  G  T
      -  S  P  A  W  C  C  L  P  T  C  H  V  C  A  I  P  G  E  E  L
      -   A  P  H  G  V  V  F  L  H  V  T  Y  V  P  S  Q  E  R  N  F
24661 - TCACCACAGCGCCAGCAATTTGTCATGAAGGCAAAGCATACTTCCCTCGTGAAGGTGTTT - 24720
      - S  P  Q  R  Q  Q  F  V  M  K  A  K  H  T  S  L  V  K  V  F
      -  H  H  S  A  S  N  L  S  *  R  Q  S  I  L  P  S  *  R  C  F
      -   T  T  A  P  A  I  C  H  E  G  K  A  Y  F  P  R  E  G  V  F
24721 - TTGTGTTTAATGGCACTTCTTGGTTTATTACACAGAGGAACTTCTTTTCTCCACAAATAA - 24780
      - L  C  L  M  A  L  L  G  L  L  H  R  G  T  S  F  L  H  K  *
      -  C  V  *  W  H  F  L  V  Y  Y  T  E  E  L  L  F  S  T  N  N
      -   V  F  N  G  T  S  W  F  I  T  Q  R  N  F  F  S  P  Q  I  I
24781 - TTACTACAGACAATACATTTGTCTCAGGAAATTGTGATGTCGTTATTGGCATCATTAACA - 24840
      - L  L  Q  T  I  H  L  S  Q  E  I  V  M  S  L  L  A  S  L  T
      -  Y  Y  R  Q  Y  I  C  L  R  K  L  *  C  R  Y  W  H  H  *  Q
      -   T  T  D  N  T  F  V  S  G  N  C  D  V  V  I  G  I  I  N  N
24841 - ACACAGTTTATGATCCTCTGCAACCTGAGCTTGACTCATTCAAAGAAGAGCTGGACAAGT - 24900
      - T  Q  F  M  I  L  C  N  L  S  L  T  H  S  K  K  S  W  T  S
      -  H  S  L  *  S  S  A  T  *  A  *  L  I  Q  R  R  A  G  Q  V
      -   T  V  Y  D  P  L  Q  P  E  L  D  S  F  K  E  E  L  D  K  Y
24901 - ACTTCAAAAATCATACATCACCAGATGTTGATCTTGGCGACATTTCAGGCATTAACGCTT - 24960
      - T  S  K  I  I  H  H  Q  M  L  I  L  A  T  F  Q  A  L  T  L
      -  L  Q  K  S  Y  I  T  R  C  *  S  W  R  H  F  R  H  *  R  F
      -   F  K  N  H  T  S  P  D  V  D  L  G  D  I  S  G  I  N  A  S
24961 - CTGTCGTCAACATTCAAAAAGAAATTGACCGCCTCAATGAGGTCGCTAAAAATTTAAATG - 25020
      - L  S  S  T  F  K  K  K  L  T  A  S  M  R  S  L  K  I  *  M
      -  C  R  Q  H  S  K  R  N  *  P  P  Q  *  G  R  *  K  F  K  *
      -   V  V  N  I  Q  K  E  I  D  R  L  N  E  V  A  K  N  L  N  E
25021 - AATCACTCATTGACCTTCAAGAATTGGGAAAATATGAGCAATATATTAAATGGCCTTGGT - 25080
      - N  H  S  L  T  F  K  N  W  E  N  M  S  N  I  L  N  G  L  G
      -  I  T  H  *  P  S  R  I  G  K  I  *  A  I  Y  *  M  A  L  V
      -   S  L  I  D  L  Q  E  L  G  K  Y  E  Q  Y  I  K  W  P  W  Y
25081 - ATGTTTGGCTCGGCTTCATTGCTGGACTAATTGCCATCGTCATGGTTACAATCTTGCTTT - 25140
      - M  F  G  S  A  S  L  L  D  *  L  P  S  S  W  L  Q  S  C  F
      -  C  L  A  R  L  H  C  W  T  N  C  H  R  H  G  Y  N  L  A  L
      -   V  W  L  G  F  I  A  G  L  I  A  I  V  M  V  T  I  L  L  C
25141 - GTTGCATGACTAGTTGTTGCAGTTGCCTCAAGGGTGCATGCTCTTGTGGTTCTTGCTGCA - 25200
      - V  A  *  L  V  V  A  V  A  S  R  V  H  A  L  V  V  L  A  A
      -  L  H  D  *  L  L  Q  L  P  Q  G  C  M  L  L  W  F  L  L  Q
      -   C  M  T  S  C  C  S  C  L  K  G  A  C  S  C  G  S  C  C  K
```

FIG. 11 Con't

```
25201 - AGTTTGATGAGGATGACTCTGAGCCAGTTCTCAAGGGTGTCAAATTACATTACACATAAA - 25260
       - S  L  M  R  M  T  L  S  Q  F  S  R  V  S  N  Y  I  T  H  K
       - V  *  *  G  *  L  *  A  S  S  Q  G  C  Q  I  T  L  H  I  N
       - F  D  E  D  D  S  E  P  V  L  K  G  V  K  L  H  Y  T  *  T
25261 - CGAACTTATGGATTTGTTTATGAGATTTTTTACTCTTGGATCAATTACTGCACAGCCAGT - 25320
       - R  T  Y  G  F  V  Y  E  I  F  Y  S  W  I  N  Y  C  T  A  S
       - E  L  M  D  L  F  M  R  F  F  T  L  G  S  I  T  A  Q  P  V
       - N  L  W  I  C  L  *  D  F  L  L  L  D  Q  L  L  H  S  Q  *
25321 - AAAAATTGACAATGCTTCTCCTGCAAGTACTGTTCATGCTACAGCAACGATACCGCTACA - 25380
       - K  N  *  Q  C  F  S  C  K  Y  C  S  C  Y  S  N  D  T  A  T
       - K  I  D  N  A  S  P  A  S  T  V  H  A  T  A  T  I  P  L  Q
       - K  L  T  M  L  L  L  Q  V  L  F  M  L  Q  Q  R  Y  R  Y  K
25381 - AGCCTCACTCCCTTTCGGATGGCTTGTTATTGGCGTTGCATTTCTTGCTGTTTTTCAGAG - 25440
       - S  L  T  P  F  R  M  A  C  Y  W  R  C  I  S  C  C  F  S  E
       - A  S  L  P  F  G  W  L  V  I  G  V  A  F  L  A  V  F  Q  S
       - P  H  S  L  S  D  G  L  L  L  A  L  H  F  L  L  F  F  R  A
25441 - CGCTACCAAAATAATTGCGCTCAATAAAAGATGGCAGCTAGCCCTTTATAAGGGCTTCCA - 25500
       - R  Y  Q  N  N  C  A  Q  *  K  M  A  A  S  P  L  *  G  L  P
       - A  T  K  I  I  A  L  N  K  R  W  Q  L  A  L  Y  K  G  F  Q
       - L  P  K  *  L  R  S  I  K  D  G  S  *  P  F  I  R  A  S  S
25501 - GTTCATTTGCAATTTACTGCTGCTATTTGTTACCATCTATTCACATCTTTTGCTTGTCGC - 25560
       - V  H  L  Q  F  T  A  A  I  C  Y  H  L  F  T  S  F  A  C  R
       - F  I  C  N  L  L  L  L  F  V  T  I  Y  S  H  L  L  L  V  A
       - S  F  A  I  Y  C  C  Y  L  L  P  S  I  H  I  F  C  L  S  L
25561 - TGCAGGTAAGGAGGCGCAATTTTTGTACCTCTATGCCTTGATATATTTTCTACAATGCAT - 25620
       - C  R  *  G  G  A  I  F  V  P  L  C  L  D  I  F  S  T  M  H
       - A  G  K  E  A  Q  F  L  Y  L  Y  A  L  I  Y  F  L  Q  C  I
       - Q  V  R  R  R  N  F  C  T  S  M  P  *  Y  I  F  Y  N  A  S
25621 - CAACGCATGTAGAATTATTATGAGATGTTGGCTTTGTTGGAAGTGCAAATCCAAGAACCC - 25680
       - Q  R  M  *  N  Y  Y  E  M  L  A  L  L  E  V  Q  I  Q  E  P
       - N  A  C  R  I  I  M  R  C  W  L  C  W  K  C  K  S  K  N  P
       - T  H  V  E  L  L  *  D  V  G  F  V  G  S  A  N  P  R  T  H
25681 - ATTACTTTATGATGCCAACTACTTTGTTTGCTGGCACACACATAACTATGACTACTGTAT - 25740
       - I  T  L  *  C  Q  L  L  C  L  L  A  H  T  *  L  *  L  L  Y
       - L  L  Y  D  A  N  Y  F  V  C  W  H  T  H  N  Y  D  Y  C  I
       - Y  F  M  M  P  T  T  L  F  A  G  T  H  I  T  M  T  T  V  Y
25741 - ACCATATAACAGTGTCACAGATACAATTGTCGTTACTGAAGGTGACGGCATTTCAACACC - 25800
       - T  I  *  Q  C  H  R  Y  N  C  R  Y  *  R  *  R  H  F  N  T
       - P  Y  N  S  V  T  D  T  I  V  V  T  E  G  D  G  I  S  T  P
       - H  I  T  V  S  Q  I  Q  L  S  L  L  K  V  T  A  F  Q  H  Q
25801 - AAAACTCAAAGAAGACTACCAAATTGGTGGTTATTCTGAGGATAGGCACTCAGGTGTTAA - 25860
       - K  T  Q  R  R  L  P  N  W  W  L  F  *  G  *  A  L  R  C  *
       - K  L  K  E  D  Y  Q  I  G  G  Y  S  E  D  R  H  S  G  V  K
       - N  S  K  K  T  T  K  L  V  V  I  L  R  I  G  T  Q  V  L  K
25861 - AGACTATGTCGTTGTACATGGCTATTTCACCGAAGTTTACTACCAGCTTGAGTCTACACA - 25920
       - R  L  C  R  C  T  W  L  F  H  R  S  L  L  P  *  V  Y  T
       - D  Y  V  V  V  H  G  Y  F  T  E  V  Y  Y  Q  L  E  S  T  Q
       - T  M  S  L  Y  M  A  I  S  P  K  F  T  T  S  L  S  L  H  K
25921 - AATTACTACAGACACTGGTATTGAAAATGCTACATTCTTCATCTTTAACAAGCTTGTTAA - 25980
       - N  Y  Y  R  H  W  Y  *  K  C  Y  I  L  H  L  *  Q  A  C  *
       - I  T  T  D  T  G  I  E  N  A  T  F  F  I  F  N  K  L  V  K
       - L  L  Q  T  L  V  L  K  M  L  H  S  S  S  L  T  S  L  L  K
25981 - AGACCCACCGAATGTGCAAATACACACAATCGACGGCTCTTCAGGAGTTGCTAATCCAGC - 26040
       - R  P  T  E  C  A  N  T  H  N  R  R  L  F  R  S  C  *  S  S
       - D  P  P  N  V  Q  I  H  T  I  D  G  S  S  G  V  A  N  P  A
       - T  H  R  M  C  K  Y  T  Q  S  T  A  L  Q  E  L  L  I  Q  Q
```

FIG. 11 Con't

```
26041 - AATGGATCCAATTTATGATGAGCCGACGACGACTACTAGCGTGCCTTTGTAAGCACAAGA - 26100
      - N  G  S  N  L  *  *  A  D  D  D  Y  *  R  A  F  V  S  T  R
      - M  D  P  I  Y  D  E  P  T  T  T  T  S  V  P  L  *  A  Q  E
      - W  I  Q  F  M  M  S  R  R  R  L  L  A  C  L  C  K  H  K  K
26101 - AAGTGAGTACGAACTTATGTACTCATTCGTTTCGGAAGAAACAGGTACGTTAATAGTTAA - 26160
      - K  *  V  R  T  Y  V  L  I  R  F  G  R  N  R  Y  V  N  S  *
      - S  E  Y  E  L  M  Y  S  F  V  S  E  E  T  G  T  L  I  V  N
      - V  S  T  N  L  C  T  H  S  F  R  K  K  Q  V  R  *  *  L  I
26161 - TAGCGTACTTCTTTTTCTTGCTTTCGTGGTATTCTTGCTAGTCACACTAGCCATCCTTAC - 26220
      - *  R  T  S  F  S  C  F  R  G  I  L  A  S  H  T  S  H  P  Y
      - S  V  L  L  F  L  A  F  V  V  F  L  L  V  T  L  A  I  L  T
      - A  Y  F  F  F  L  L  S  W  Y  S  C  *  S  H  *  P  S  L  L
26221 - TGCGCTTCGATTGTGTGCGTACTGCTGCAATATTGTTAACGTGAGTTTAGTAAAACCAAC - 26280
      - C  A  S  I  V  C  V  L  L  Q  Y  C  *  R  E  F  S  K  T  N
      - A  L  R  L  C  A  Y  C  C  N  I  V  N  V  S  L  V  K  P  T
      - R  F  D  C  V  R  T  A  A  I  L  L  T  *  V  *  *  N  Q  R
26281 - GGTTTACGTCTACTCGCGTGTTAAAAATCTGAACTCTTCTGAAGGAGTTCCTGATCTTCT - 26340
      - G  L  R  L  L  A  C  *  K  S  E  L  F  *  R  S  S  *  S  S
      - V  Y  V  Y  S  R  V  K  N  L  N  S  S  E  G  V  P  D  L  L
      - F  T  S  T  R  V  L  K  I  *  T  L  L  K  E  F  L  I  F  W
26341 - GGTCTAAACGAACTAACTATTATTATTATTCTGTTTGGAACTTTAACATTGCTTATCATG - 26400
      - G  L  N  E  L  T  I  I  I  I  L  F  G  T  L  T  L  L  I  M
      - V  *  T  N  *  L  L  L  L  F  C  L  E  L  *  H  C  L  S  W
      - S  K  R  T  N  Y  Y  Y  Y  S  V  W  N  F  N  I  A  Y  H  G
26401 - GCAGACAACGGTACTATTACCGTTGAGGAGCTTAAACAACTCCTGGAACAATGGAACCTA - 26460
      - A  D  N  G  T  I  T  V  E  E  L  K  Q  L  L  E  Q  W  N  L
      - Q  T  T  V  L  L  P  L  R  S  L  N  N  S  W  N  N  G  T  *
      - R  Q  R  Y  Y  Y  R  *  G  A  *  T  T  P  G  T  M  E  P  S
26461 - GTAATAGGTTTCCTATTCCTAGCCTGGATTATGTTACTACAATTTGCCTATTCTAATCGG - 26520
      - V  I  G  F  L  F  L  A  W  I  M  L  L  Q  F  A  Y  S  N  R
      - *  *  V  S  Y  S  *  P  G  L  C  Y  Y  N  L  P  I  L  I  G
      - N  R  F  P  I  P  S  L  D  Y  V  T  T  I  C  L  F  *  S  E
26521 - AACAGGTTTTTGTACATAATAAAGCTTGTTTTCCTCTGGCTCTTGTGGCCAGTAACACTT - 26580
      - N  R  F  L  Y  I  I  K  L  V  F  L  W  L  L  W  P  V  T  L
      - T  G  F  C  T  *  *  S  L  F  S  S  G  S  C  G  Q  *  H  L
      - Q  V  F  V  H  N  K  A  C  F  P  L  A  L  V  A  S  N  T  C
26581 - GCTTGTTTTGTGCTTGCTGTTGTCTACAGAATTAATTGGGTGACTGGCGGGATTGCGATT - 26640
      - A  C  F  V  L  A  V  V  Y  R  I  N  W  V  T  G  G  I  A  I
      - L  V  L  C  L  L  L  S  T  E  L  I  G  *  L  A  G  L  R  L
      - L  F  C  A  C  C  C  L  Q  N  *  L  G  D  W  R  D  C  D  C
26641 - GCAATGGCTTGTATTGTAGGCTTGATGTGGCTTAGCTACTTCGTTGCTTCCTTCAGGCTG - 26700
      - A  M  A  C  I  V  G  L  M  W  L  S  Y  F  V  A  S  F  R  L
      - Q  W  L  V  L  *  A  *  C  G  L  A  T  S  L  L  P  S  G  C
      - N  G  L  Y  C  R  L  D  V  A  *  L  L  R  C  F  L  Q  A  V
26701 - TTTGCTCGTACCCGCTCAATGTGGTCATTCAACCCAGAAACAAACATTCTTCTCAATGTG - 26760
      - F  A  R  T  R  S  M  W  S  F  N  P  E  T  N  I  L  L  N  V
      - L  L  V  P  A  Q  C  G  H  S  T  Q  K  Q  T  F  F  S  M  C
      - C  S  Y  P  L  N  V  V  I  Q  P  R  N  K  H  S  S  Q  C  A
26761 - CCTCTCCGGGGGACAATTGTGACCAGACCGCTCATGGAAAGTGAACTTGTCATTGGTGCT - 26820
      - P  L  R  G  T  I  V  T  R  P  L  M  E  S  E  L  V  I  G  A
      - L  S  G  G  Q  L  *  P  D  R  S  W  K  V  N  L  S  L  V  L
      - S  P  G  D  N  C  D  Q  T  A  H  G  K  *  T  C  H  W  C  C
26821 - GTGATCATTCGTGGTCACTTGCGAATGGCCGGACACTCCCTAGGGCGCTGTGACATTAAG - 26880
      - V  I  I  R  G  H  L  R  M  A  G  H  S  L  G  R  C  D  I  K
      - *  S  F  V  V  T  C  E  W  P  D  T  P  *  G  A  V  T  L  R
      - D  H  S  W  S  L  A  N  G  R  T  L  P  R  A  L  *  H  *  G
```

FIG. 11 Con't

```
26881 - GACCTGCCAAAAGAGATCACTGTGGCTACATCACGAACGCTTTCTTATTACAAATTAGGA - 26940
      - D  L  P  K  E  I  T  V  A  T  S  R  T  L  S  Y  Y  K  L  G
      - T  C  Q  K  R  S  L  W  L  H  H  E  R  F  L  I  T  N  *  E
      - P  A  K  R  D  H  C  G  Y  I  T  N  A  F  L  L  Q  I  R  S
26941 - GCGTCGCAGCGTGTAGGCACTGATTCAGGTTTTGCTGCATACAACCGCTACCGTATTGGA - 27000
      - A  S  Q  R  V  G  T  D  S  G  F  A  A  Y  N  R  Y  R  I  G
      - R  R  S  V  *  A  L  I  Q  V  L  L  H  T  T  A  T  V  L  E
      - V  A  A  C  R  H  *  F  R  F  C  C  I  Q  P  L  P  Y  W  K
27001 - AACTATAAATTAAATACAGACCACGCCGGTAGCAACGACAATATTGCTTTGCTAGTACAG - 27060
      - N  Y  K  L  N  T  D  H  A  G  S  N  D  N  I  A  L  L  V  Q
      - T  I  N  *  I  Q  T  T  P  V  A  T  T  I  L  L  C  *  Y  S
      - L  *  I  K  Y  R  P  R  R  *  Q  R  Q  Y  C  F  A  S  T  V
27061 - TAAGTGACAACAGATGTTTCATCTTGTTGACTTCCAGGTTACAATAGCAGAGATATTGAT - 27120
      - *  V  T  T  D  V  S  S  C  *  L  P  G  Y  N  S  R  D  I  D
      - K  *  Q  Q  M  F  H  L  V  D  F  Q  V  T  I  A  E  I  L  I
      - S  D  N  R  C  F  I  L  L  T  S  R  L  Q  *  Q  R  Y  *  L
27121 - TATCATTATGAGGACTTTCAGGATTGCTATTTGGAATCTTGACGTTATAATAAGTTCAAT - 27180
      - Y  H  Y  E  D  F  Q  D  C  Y  L  E  S  *  R  Y  N  K  F  N
      - I  I  M  R  T  F  R  I  A  I  W  N  L  D  V  I  I  S  S  I
      - S  L  *  G  L  S  G  L  L  F  G  I  L  T  L  *  *  V  Q  *
27181 - AGTGAGACAATTATTTAAGCCTCTAACTAAGAAGAATTATTCGGAGTTAGATGATGAAGA - 27240
      - S  E  T  I  I  *  A  S  N  *  E  E  L  F  G  V  R  *  *  R
      - V  R  Q  L  F  K  P  L  T  K  K  N  Y  S  E  L  D  D  E  E
      - *  D  N  Y  L  S  L  *  L  R  R  I  I  R  S  *  M  M  K  N
27241 - ACCTATGGAGTTAGATTATCCATAAAACGAACATGAAAATTATTCTCTTCCTGACATTGA - 27300
      - T  Y  G  V  R  L  S  I  K  R  T  *  K  L  F  S  S  *  H  *
      - P  M  E  L  D  Y  P  *  N  E  H  E  N  Y  S  L  P  D  I  D
      - L  W  S  *  I  I  H  K  T  N  M  K  I  I  L  F  L  T  L  I
27301 - TTGTATTTACATCTTGCGAGCTATATCACTATCAGGAGTGTGTTAGAGGTACGACTGTAC - 27360
      - L  Y  L  H  L  A  S  Y  I  T  I  R  S  V  L  E  V  R  L  Y
      - C  I  Y  I  L  R  A  I  S  L  S  G  V  C  *  R  Y  D  C  T
      - V  F  T  S  C  E  L  Y  H  Y  Q  E  C  V  R  G  T  T  V  L
27361 - TACTAAAAGAACCTTGCCCATCAGGAACATACGAGGGCAATTCACCATTTCACCCTCTTG - 27420
      - Y  *  K  N  L  A  H  Q  E  H  T  R  A  I  H  H  F  T  L  L
      - T  K  R  T  L  P  I  R  N  I  R  G  Q  F  T  I  S  P  S  C
      - L  K  E  P  C  P  S  G  T  Y  E  G  N  S  P  F  H  P  L  A
27421 - CTGACAATAAATTTGCACTAACTTGCACTAGCACACACTTTGCTTTTGCTTGTGCTGACG - 27480
      - L  T  I  N  L  H  *  L  A  L  A  H  T  L  L  L  L  V  L  T
      - *  Q  *  I  C  T  N  L  H  *  H  T  L  C  F  C  L  C  *  R
      - D  N  K  F  A  L  T  C  T  S  T  H  F  A  F  A  C  A  D  G
27481 - GTACTCGACATACCTATCAGCTGCGTGCAAGATCAGTTTCACCAAAACTTTTCATCAGAC - 27540
      - V  L  D  I  P  I  S  C  V  Q  D  Q  F  H  Q  N  F  S  S  D
      - Y  S  T  Y  L  S  A  A  C  K  I  S  F  T  K  T  F  H  Q  T
      - T  R  H  T  Y  Q  L  R  A  R  S  V  S  P  K  L  F  I  R  Q
27541 - AAGAGGAGGTTCAACAAGAGCTCTACTCGCCACTTTTTCTCATTGTTGCTGCTCTAGTAT - 27600
      - K  R  R  F  N  K  S  S  T  R  H  F  F  S  L  L  L  L  *  Y
      - R  G  G  S  T  R  A  L  L  A  T  F  S  H  C  C  C  S  S  I
      - E  E  V  Q  Q  E  L  Y  S  P  L  F  L  I  V  A  A  L  V  F
27601 - TTTTAATACTTTGCTTCACCATTAAGAGAAAGACAGAATGAATGAGCTCACTTTAATTGA - 27660
      - F  *  Y  F  A  S  P  L  R  E  R  Q  N  E  *  A  H  F  N  *
      - F  N  T  L  L  H  H  *  E  K  D  R  M  N  E  L  T  L  I  D
      - L  I  L  C  F  T  I  K  R  K  T  E  *  M  S  S  L  *  L  T
27661 - CTTCTATTTGTGCTTTTTAGCCTTTCTGCTATTCCTTGTTTTAATAATGCTTATTATATT - 27720
      - L  L  F  V  L  F  S  L  S  A  I  P  C  F  N  N  A  Y  Y  I
      - F  Y  L  C  F  L  A  F  L  L  F  L  V  L  I  M  L  I  I  F
      - S  I  C  A  F  *  P  F  C  Y  S  L  F  *  *  C  L  L  Y  F
```

FIG. 11 Con't

```
27721 - TTGGTTTTCACTCGAAATCCAGGATCTAGAAGAACCTTGTACCAAAGTCTAAACGAACAT - 27780
       - L  V  F  T  R  N  P  G  S  R  R  T  L  Y  Q  S  L  N  E  H
       -  W  F  S  L  E  I  Q  D  L  E  E  P  C  T  K  V  *  T  N  M
       -   G  F  H  S  K  S  R  I  *  K  N  L  V  P  K  S  R  T  *
27781 - GAAACTTCTCATTGTTTTGACTTGTATTTCTCTATGCAGTTGCATATGCACTGTAGTACA - 27840
       - E  T  S  H  C  F  D  L  Y  F  S  M  Q  L  H  M  H  C  S  T
       -  K  L  L  I  V  L  T  C  I  S  L  C  S  C  I  C  T  V  V  Q
       -   N  F  S  L  F  *  L  V  F  L  Y  A  V  A  Y  A  L  *  Y  S
27841 - GCGCTGTGCATCTAATAAACCTCATGTGCTTGAAGATCCTTGTAAGGTACAACACTAGGG - 27900
       - A  L  C  I  *  *  T  S  C  A  *  R  S  L  *  G  T  T  L  G
       -  R  C  A  S  N  K  P  H  V  L  E  D  P  C  K  V  Q  H  *  G
       -   A  V  H  L  I  N  L  M  C  L  K  I  L  V  R  Y  N  T  R  G
27901 - GTAATACTTATAGCACTGCTTGGCTTTGTGCTCTAGGAAAGGTTTTACCTTTTCATAGAT - 27960
       - V  I  L  I  A  L  L  G  F  V  L  *  E  R  F  Y  L  F  I  D
       -  *  Y  L  *  H  C  L  A  L  C  S  R  K  G  F  T  F  S  *  M
       -   N  T  Y  S  T  A  W  L  C  A  L  G  K  V  L  P  F  H  R  W
27961 - GGCACACTATGGTTCAAACATGCACACCTAATGTTACTATCAACTGTCAAGATCCAGCTG - 28020
       - G  T  L  W  F  K  H  A  H  L  M  L  L  S  T  V  K  I  Q  L
       -  A  H  Y  G  S  N  M  H  T  *  C  Y  Y  Q  L  S  R  S  S  W
       -   H  T  M  V  Q  T  C  T  P  N  V  T  I  N  C  Q  D  P  A  G
28021 - GTGGTGCGCTTATAGCTAGGTGTTGGTACCTTCATGAAGGTCACCAAACTGCTGCATTTA - 28080
       - V  V  R  L  *  L  G  V  G  T  F  M  K  V  T  K  L  L  H  L
       -  W  C  A  Y  S  *  V  L  V  P  S  *  R  S  P  N  C  C  I  *
       -   G  A  L  I  A  R  C  W  Y  L  H  E  G  H  Q  T  A  A  F  R
28081 - GAGACGTACTTGTTGTTTTAAATAAACGAACAAATTAAAATGTCTGATAATGGACCCCAA - 28140
       - E  T  Y  L  L  F  *  I  N  E  Q  I  K  M  S  D  N  G  P  Q
       -  R  R  T  C  C  F  K  *  T  N  K  L  K  C  L  I  M  D  P  N
       -   D  V  L  V  V  L  N  K  R  T  N  *  N  V  *  *  W  T  P  I
28141 - TCAAACCAACGTAGTGCCCCCCGCATTACATTTGGTGGACCCACAGATTCAACTGACAAT - 28200
       - S  N  Q  R  S  A  P  R  I  T  F  G  G  P  T  D  S  T  D  N
       -  Q  T  N  V  V  P  P  A  L  H  L  V  D  P  Q  I  Q  L  T  I
       -   K  P  T  *  C  P  P  H  Y  I  W  W  T  H  R  F  N  *  Q  *
28201 - AACCAGAATGGAGGACGCAATGGGGCAAGGCCAAAACAGCGCCGACCCCAAGGTTTACCC - 28260
       - N  Q  N  G  G  R  N  G  A  R  P  K  Q  R  R  P  Q  G  L  P
       -  T  R  M  E  D  A  M  G  Q  G  Q  N  S  A  D  P  K  V  Y  P
       -   P  E  W  R  T  Q  W  G  K  A  K  T  A  P  T  P  R  F  T  Q
28261 - AATAATACTGCGTCTTGGTTCACAGCTCTCACTCAGCATGGCAAGGAGGAACTTAGATTC - 28320
       - N  N  T  A  S  W  F  T  A  L  T  Q  H  G  K  E  E  L  R  F
       -  I  I  L  R  L  G  S  Q  L  S  L  S  M  A  R  R  N  L  D  S
       -   *  Y  C  V  L  V  H  S  S  H  S  A  W  Q  G  G  T  *  I  P
28321 - CCTCGAGGCCAGGGCGTTCCAATCAACACCAATAGTGGTCCAGATGACCAAATTGGCTAC - 28380
       - P  R  G  Q  G  V  P  I  N  T  N  S  G  P  D  D  Q  I  G  Y
       -  L  E  A  R  A  F  Q  S  T  P  I  V  V  Q  M  T  K  L  A  T
       -   S  R  P  G  R  S  N  Q  H  Q  *  W  S  R  *  P  N  W  L  L
28381 - TACCGAAGAGCTACCCGACGAGTTCGTGGTGGTGACGGCAAAATGAAAGAGCTCAGCCCC - 28440
       - Y  R  R  A  T  R  R  V  R  G  G  D  G  K  M  K  E  L  S  P
       -  T  E  E  L  P  D  E  F  V  V  V  T  A  K  *  K  S  S  A  P
       -   P  K  S  Y  P  T  S  S  W  W  *  R  Q  N  E  R  A  Q  P  Q
28441 - AGATGGTACTTCTATTACCTAGGAACTGGCCCAGAAGCTTCACTTCCCTACGGCGCTAAC - 28500
       - R  W  Y  F  Y  Y  L  G  T  G  P  E  A  S  L  P  Y  G  A  N
       -  D  G  T  S  I  T  *  E  L  A  Q  K  L  H  F  P  T  A  L  T
       -   M  V  L  L  L  P  R  N  W  P  R  S  F  T  S  L  R  R  *  Q
28501 - AAAGAAGGCATCGTATGGGTTGCAACTGAGGGAGCCTTGAATACACCCAAAGACCACATT - 28560
       - K  E  G  I  V  W  V  A  T  E  G  A  L  N  T  P  K  D  H  I
       -  K  K  A  S  Y  G  L  Q  L  R  E  P  *  I  H  P  K  T  T  L
       -   R  R  H  R  M  G  C  N  *  G  S  L  E  Y  T  Q  R  P  H  W
```

FIG. 11 Con't

```
28561 - GGCACCCGCAATCCTAATAACAATGCTGCCACCGTGCTACAACTTCCTCAAGGAACAACA - 28620
       - G  T  R  N  P  N  N  N  A  A  T  V  L  Q  L  P  Q  G  T  T
       -  A  P  A  I  L  I  T  M  L  P  P  C  Y  N  F  L  K  E  Q  H
       -   H  P  Q  S  *  *  Q  C  C  H  R  A  T  T  S  S  R  N  N  I
28621 - TTGCCAAAAGGCTTCTACGCAGAGGGAAGCAGAGGCGGCAGTCAAGCCTCTTCTCGCTCC - 28680
       - L  P  K  G  F  Y  A  E  G  S  R  G  G  S  Q  A  S  S  R  S
       -  C  Q  K  A  S  T  Q  R  E  A  E  A  A  V  K  P  L  L  A  P
       -   A  K  R  L  L  R  R  G  K  Q  R  R  Q  S  S  L  F  S  L  L
28681 - TCATCACGTAGTCGCGGTAATTCAAGAAATTCAACTCCTGGCAGCAGTAGGGGAAATTCT - 28740
       - S  S  R  S  R  G  N  S  R  N  S  T  P  G  S  S  R  G  N  S
       -  H  H  V  V  A  V  I  Q  E  I  Q  L  L  A  A  V  G  E  I  L
       -   I  T  *  S  R  *  F  K  K  F  N  S  W  Q  Q  *  G  K  F  S
28741 - CCTGCTCGAATGGCTAGCGGAGGTGGTGAAACTGCCCTCGCGCTATTGCTGCTAGACAGA - 28800
       - P  A  R  M  A  S  G  G  G  E  T  A  L  A  L  L  L  L  D  R
       -  L  L  E  W  L  A  E  V  V  K  L  P  S  R  Y  C  C  *  T  D
       -   C  S  N  G  *  R  R  W  *  N  C  P  R  A  I  A  A  R  Q  I
28801 - TTGAACCAGCTTGAGAGCAAAGTTTCTGGTAAAGGCCAACAACAACAAGGCCAAACTGTC - 28860
       - L  N  Q  L  E  S  K  V  S  G  K  G  Q  Q  Q  Q  G  Q  T  V
       -  *  T  S  L  R  A  K  F  L  V  K  A  N  N  N  K  A  K  L  S
       -   E  P  A  *  E  Q  S  F  W  *  R  P  T  T  T  R  P  N  C  H
28861 - ACTAAGAAATCTGCTGCTGAGGCATCTAAAAAGCCTCGCCAAAAACGTACTGCCACAAAA - 28920
       - T  K  K  S  A  A  E  A  S  K  K  P  R  Q  K  R  T  A  T  K
       -  L  R  N  L  L  L  R  H  L  K  S  L  A  K  N  V  L  P  Q  N
       -   *  E  I  C  C  *  G  I  *  K  A  S  P  K  T  Y  C  H  K  T
28921 - CAGTACAACGTCACTCAAGCATTTGGGAGACGTGGTCCAGAACAAACCCAAGGAAATTTC - 28980
       - Q  Y  N  V  T  Q  A  F  G  R  R  G  P  E  Q  T  Q  G  N  F
       -  S  T  T  S  L  K  H  L  G  D  V  V  Q  N  K  P  K  E  I  S
       -   V  Q  R  H  S  S  I  W  E  T  W  S  R  T  N  P  R  K  F  R
28981 - GGGGACCAAGACCTAATCAGACAAGGAACTGATTACAAACATTGGCCGCAAATTGCACAA - 29040
       - G  D  Q  D  L  I  R  Q  G  T  D  Y  K  H  W  P  Q  I  A  Q
       -  G  T  K  T  *  S  D  K  E  L  I  T  N  I  G  R  K  L  H  N
       -   G  P  R  P  N  Q  T  R  N  *  L  Q  T  L  A  A  N  C  T  I
29041 - TTTGCTCCAAGTGCCTCTGCATTCTTTGGAATGTCACGCATTGGCATGGAAGTCACACCT - 29100
       - F  A  P  S  A  S  A  F  F  G  M  S  R  I  G  M  E  V  T  P
       -  L  L  Q  V  P  L  H  S  L  E  C  H  A  L  A  W  K  S  H  L
       -   C  S  K  C  L  C  I  L  W  N  V  T  H  W  H  G  S  H  T  F
29101 - TCGGGAACATGGCTGACTTATCATGGAGCCATTAAATTGGATGACAAAGATCCACAATTC - 29160
       - S  G  T  W  L  T  Y  H  G  A  I  K  L  D  D  K  D  P  Q  F
       -  R  E  H  G  *  L  I  M  E  P  L  N  W  M  T  K  I  H  N  S
       -   G  N  M  A  D  L  S  W  S  H  *  I  G  *  Q  R  S  T  I  Q
29161 - AAAGACAACGTCATACTGCTGAACAAGCACATTGACGCATACAAAACATTCCCACCAACA - 29220
       - K  D  N  V  I  L  L  N  K  H  I  D  A  Y  K  T  F  P  P  T
       -  K  T  T  S  Y  C  *  T  S  T  L  T  H  T  K  H  S  H  Q  Q
       -   R  Q  R  H  T  A  E  Q  A  H  *  R  I  Q  N  I  P  T  N  R
29221 - GAGCCTAAAAAGGACAAAAAGAAAAAGACTGATGAAGCTCAGCCTTTGCCGCAGAGACAA - 29280
       - E  P  K  K  D  K  K  K  K  T  D  E  A  Q  P  L  P  Q  R  Q
       -  S  L  K  R  T  K  R  K  R  L  M  K  L  S  L  C  R  R  D  K
       -   A  *  K  G  Q  K  E  K  D  *  *  S  S  A  F  A  A  E  T  K
29281 - AAGAAGCAGCCCACTGTGACTCTTCTTCCTGCGGCTGACATGGATGATTTCTCCAGACAA - 29340
       - K  K  Q  P  T  V  T  L  L  P  A  A  D  M  D  D  F  S  R  Q
       -  R  S  S  P  L  *  L  F  F  L  R  L  T  W  M  I  S  P  D  N
       -   E  A  A  H  C  D  S  S  S  C  G  *  H  G  *  F  L  Q  T  T
29341 - CTTCAAAATTCCATGAGTGGAGCTTCTGCTGATTCAACTCAGGCATAAACACTCATGATG - 29400
       - L  Q  N  S  M  S  G  A  S  A  D  S  T  Q  A  *  T  L  M  M
       -  F  K  I  P  *  V  E  L  L  L  I  Q  L  R  H  K  H  S  *  *
       -   S  K  F  H  E  W  S  F  C  *  F  N  S  G  I  N  T  H  D  D
```

FIG. 11 Con't

```
29401 - ACCACACAAGGCAGATGGGCTATGTAAACGTTTTCGCAATTCCGTTTACGATACATAGTC - 29460
      - T T Q G R W A M * T F S Q F R L R Y I V
      -  P H K A D G L C K R F R N S V Y D T * S
      -   H T R Q M G Y V N V F A I P F T I H S L
29461 - TACTCTTGTGCAGAATGAATTCTCGTAACTAAACAGCACAAGTAGGTTTAGTTAACTTTA - 29520
      - Y S C A E * I L V T K Q H K * V * L T L
      -  T L V Q N E F S * L N S T S R F S * L *
      -   L L C R M N S R N * T A Q V G L V N F N
29521 - ATCTCACATAGCAATCTTTAATCAATGTGTAACATTAGGGAGGACTTGAAAGAGCCACCA - 29580
      - I S H S N L * S M C N I R E D L K E P P
      -  S H I A I F N Q C V T L G R T * K S H H
      -   L T * Q S L I N V * H * G G L E R A T T
29581 - CATTTTCATCGAGGCCACGCGGAGTACGATCGAGGGTACAGTGAATAATGCTAGGGAGAG - 29640
      - H F H R G H A E Y D R G Y S E * C * G E
      -  I F I E A T R S T I E G T V N N A R E S
      -   F S S R P R G V R S R V Q * I M L G R A
29641 - CTGCCTATATGGAAGAGCCCTAATGTGTAAAATTAATTTTAGTAGTGCTATCCCCATGTG - 29700
      - L P I W K S P N V * N * F * * C Y P H V
      -  C L Y G R A L M C K I N F S S A I P M *
      -   A Y M E E P * C V K L I L V V L S P C D
29701 - ATTTTAATAGCTTCTTAGGAGAATGACAAAAAAAAAAAAAA   - 29742
      - I L I A S * E N D K K K K K X
      -  F * * L L R R M T K K K K X
      -   F N S F L G E * Q K K K K X
```

FIG. 11 Con't

```
  1 - TTTTTTTTTTTTTTTGTCATTCTCCTAAGAAGCTATTAAAATCACATGGGGATAGCACTA -  60
    -  F  F  F  F  F  V  I  L  L  R  S  Y  *  N  H  M  G  I  A  L
    -   F  F  F  F  L  S  F  S  *  E  A  I  K  I  T  W  G  *  H  Y
    -    F  F  F  F  C  H  S  P  K  K  L  L  K  S  H  G  D  S  T  T
 61 - CTAAAATTAATTTTACACATTAGGGCTCTTCCATATAGGCAGCTCTCCCTAGCATTATTC - 120
    -  L  K  L  I  L  H  I  R  A  L  P  Y  R  Q  L  S  L  A  L  F
    -   *  N  *  F  Y  T  L  G  L  F  H  I  G  S  S  P  *  H  Y  S
    -    K  I  N  F  T  H  *  G  S  S  I  *  A  A  L  P  S  I  I  H
121 - ACTGTACCCTCGATCGTACTCCGCGTGGCCTCGATGAAAATGTGGTGGCTCTTTCAAGTC - 180
    -  T  V  P  S  I  V  L  R  V  A  S  M  K  M  W  W  L  F  Q  V
    -   L  Y  P  R  S  Y  S  A  W  P  R  *  K  C  G  G  S  F  K  S
    -    C  T  L  D  R  T  P  R  G  L  D  E  N  V  V  A  L  S  S  P
181 - CTCCCTAATGTTACACATTGATTAAAGATTGCTATGTGAGATTAAAGTTAACTAAACCTA - 240
    -  L  P  N  V  T  H  *  L  K  I  A  M  *  D  *  S  *  L  N  L
    -   S  L  M  L  H  I  D  *  R  L  L  C  E  I  K  V  N  *  T  Y
    -    P  *  C  Y  T  L  I  K  D  C  Y  V  R  L  K  L  T  K  P  T
241 - CTTGTGCTGTTTAGTTACGAGAATTCATTCTGCACAAGAGTAGACTATGTATCGTAAACG - 300
    -  L  V  L  F  S  Y  E  N  S  F  C  T  R  V  D  Y  V  S  *  T
    -   L  C  C  L  V  T  R  I  H  S  A  Q  E  *  T  M  Y  R  K  R
    -    C  A  V  *  L  R  E  F  I  L  H  K  S  R  L  C  I  V  N  G
301 - GAATTGCGAAAACGTTTACATAGCCCATCTGCCTTGTGTGGTCATCATGAGTGTTTATGC - 360
    -  E  L  R  K  R  L  H  S  P  S  A  L  C  G  H  H  E  C  L  C
    -   N  C  E  N  V  Y  I  A  H  L  P  C  V  V  I  M  S  V  Y  A
    -    I  A  K  T  F  T  *  P  I  C  L  V  W  S  S  *  V  F  M  P
361 - CTGAGTTGAATCAGCAGAAGCTCCACTCATGGAATTTTGAAGTTGTCTGGAGAAATCATC - 420
    -  L  S  *  I  S  R  S  S  T  H  G  I  L  K  L  S  G  E  I  I
    -   *  V  E  S  A  E  A  P  L  M  E  F  *  S  C  L  E  K  S  S
    -    E  L  N  Q  Q  K  L  H  S  W  N  F  E  V  V  W  R  N  H  P
421 - CATGTCAGCCGCAGGAAGAAGAGTCACAGTGGGCTGCTTCTTTTGTCTCTGCGGCAAAGG - 480
    -  H  V  S  R  R  K  K  S  H  S  G  L  L  L  L  S  L  R  Q  R
    -   M  S  A  A  G  R  R  V  T  V  G  C  F  F  C  L  C  G  K  G
    -    C  Q  P  Q  E  E  E  S  Q  W  A  A  S  F  V  S  A  A  K  A
481 - CTGAGCTTCATCAGTCTTTTTCTTTTTGTCCTTTTTAGGCTCTGTTGGTGGGAATGTTTT - 540
    -  L  S  F  I  S  L  F  L  F  V  L  F  R  L  C  W  W  E  C  F
    -   *  A  S  S  V  F  F  F  L  S  F  L  G  S  V  G  G  N  V  L
    -    E  L  H  Q  S  F  S  F  C  P  F  *  A  L  L  V  G  M  F  C
541 - GTATGCGTCAATGTGCTTGTTCAGCAGTATGACGTTGTCTTTGAATTGTGGATCTTTGTC - 600
    -  V  C  V  N  V  L  V  Q  Q  Y  D  V  V  F  E  L  W  I  F  V
    -   Y  A  S  M  C  L  F  S  S  M  T  L  S  L  N  C  G  S  L  S
    -    M  R  Q  C  A  C  S  A  V  *  R  C  L  *  I  V  D  L  C  H
601 - ATCCAATTTAATGGCTCCATGATAAGTCAGCCATGTTCCGAAGGTGTGACTTCCATGCC - 660
    -  I  Q  F  N  G  S  M  I  S  Q  P  C  S  R  R  C  D  F  H  A
    -   S  N  L  M  A  P  *  *  V  S  H  V  P  E  G  V  T  S  M  P
    -    P  I  *  W  L  H  D  K  S  A  M  F  P  K  V  *  L  P  C  Q
661 - AATGCGTGACATTCCAAAGAATGCAGAGGCACTTGGAGCAAATTGTGCAATTTGCGGCCA - 720
    -  N  A  *  H  S  K  E  C  R  G  T  W  S  K  L  C  N  L  R  P
    -   M  R  D  I  P  K  N  A  E  A  L  G  A  N  C  A  I  C  G  Q
    -    C  V  T  F  Q  R  M  Q  R  H  L  E  Q  I  V  Q  F  A  A  N
721 - ATGTTTGTAATCAGTTCCTTGTCTGATTAGGTCTTGGTCCCCGAAATTTCCTTGGGTTTG - 780
    -  M  F  V  I  S  S  L  S  D  *  V  L  V  P  E  I  S  L  G  L
    -   C  L  *  S  V  P  C  L  I  R  S  W  S  P  K  F  P  W  V  C
    -    V  C  N  Q  F  L  V  *  L  G  L  G  P  R  N  F  L  G  F  V
781 - TTCTGGACCACGTCTCCCAAATGCTTGAGTGACGTTGTACTGTTTTGTGGCAGTACGTTT - 840
    -  F  W  T  T  S  P  K  C  L  S  D  V  V  L  F  C  G  S  T  F
    -   S  G  P  R  L  P  N  A  *  V  T  L  Y  C  F  V  A  V  R  F
    -    L  D  H  V  S  Q  M  L  E  *  R  C  T  V  L  W  Q  Y  V  F
```

FIG. 12

```
841 - TTGGCGAGGCTTTTTAGATGCCTCAGCAGCAGATTTCTTAGTGACAGTTTGGCCTTGTTG - 900
    - L  A  R  L  F  R  C  L  S  S  R  F  L  S  D  S  L  A  L  L
    - W  R  G  F  L  D  A  S  A  A  D  F  L  V  T  V  W  P  C  C
    - G  E  A  F  *  M  P  Q  Q  Q  I  S  *  *  Q  F  G  L  V  V
901 - TTGTTGGCCTTTTACCAGAAACTTTGCTCTCAAGCTGGTTCAATCTGTCTAGCAGCAATAG - 960
    - L  L  A  F  T  R  N  F  A  L  K  L  V  Q  S  V  *  Q  Q  *
    - C  W  P  L  P  E  T  L  L  S  S  W  F  N  L  S  S  S  N  S
    - V  G  L  Y  Q  K  L  C  S  Q  A  G  S  I  C  L  A  A  I  A
961 - CGCGAGGGCAGTTTCACCACCTCCGCTAGCCATTCGAGCAGGAGAATTTCCCCTACTGCT - 1020
    - R  E  G  S  F  T  T  S  A  S  H  S  S  R  R  I  S  P  T  A
    - A  R  A  V  S  P  P  P  L  A  I  R  A  G  E  F  P  L  L  L
    - R  G  Q  F  H  H  L  R  *  P  F  E  Q  E  N  F  P  Y  C  C
1021 - GCCAGGAGTTGAATTTCTTGAATTACCGCGACTACGTGATGAGGAGCGAGAAGAGGCTTG - 1080
    - A  R  S  *  I  S  *  I  T  A  T  T  *  *  G  A  R  R  G  L
    - P  G  V  E  F  L  E  L  P  R  L  R  D  E  E  R  E  E  A  *
    - Q  E  L  N  F  L  N  Y  R  D  Y  V  M  R  S  E  K  R  L  D
1081 - ACTGCCGCCTCTGCTTCCCTCTGCGTAGAAGCCTTTTGGCAATGTTGTTCCTTGAGGAAG - 1140
    - T  A  A  S  A  S  L  C  V  E  A  F  W  Q  C  C  S  L  R  K
    - L  P  P  L  L  P  S  A  *  K  P  F  G  N  V  V  P  *  G  S
    - C  R  L  C  F  P  L  R  R  S  L  L  A  M  L  F  L  E  E  V
1141 - TTGTAGCACGGTGGCAGCATTGTTATTAGGATTGCGGGTGCCAATGTGGTCTTTGGGTGT - 1200
    - L  *  H  G  G  S  I  V  I  R  I  A  G  A  N  V  V  F  G  C
    - C  S  T  V  A  A  L  L  L  G  L  R  V  P  M  W  S  L  G  V
    - V  A  R  W  Q  H  C  Y  *  D  C  G  C  Q  C  G  L  W  V  Y
1201 - ATTCAAGGCTCCCTCAGTTGCAACCCATACGATGCCTTCTTTGTTAGCGCCGTAGGGAAG - 1260
    - I  Q  G  S  L  S  C  N  P  Y  D  A  F  F  V  S  A  V  G  K
    - F  K  A  P  S  V  A  T  H  T  M  P  S  L  L  A  P  *  G  S
    - S  R  L  P  Q  L  Q  P  I  R  C  L  L  C  *  R  R  R  E  V
1261 - TGAAGCTTCTGGGCCAGTTCCTAGGTAATAGAAGTACCATCTGGGGCTGAGCTCTTTCAT - 1320
    - *  S  F  W  A  S  S  *  V  I  E  V  P  S  G  A  E  L  F  H
    - E  A  S  G  P  V  P  R  *  *  K  Y  H  L  G  L  S  S  F  I
    - K  L  L  G  Q  F  L  G  N  R  S  T  I  W  G  *  A  L  S  F
1321 - TTTGCCGTCACCACCACGAACTCGTCGGGTAGCTCTTCGGTAGTAGCCAATTTGGTCATC - 1380
    - F  A  V  T  T  T  N  S  S  G  S  S  S  V  V  A  N  L  V  I
    - L  P  S  P  P  R  T  R  R  V  A  L  R  *  *  P  I  W  S  S
    - C  R  H  H  H  E  L  V  G  *  L  F  G  S  S  Q  F  G  H  L
1381 - TGGACCACTATTGGTGTTGATTGGAACGCCCTGGCCTCGAGGGAATCTAAGTTCCTCCTT - 1440
    - W  T  T  I  G  V  D  W  N  A  L  A  S  R  E  S  K  F  L  L
    - G  P  L  L  V  L  I  G  T  P  W  P  R  G  N  L  S  S  S  L
    - D  H  Y  W  C  *  L  E  R  P  G  L  E  G  I  *  V  P  P  C
1441 - GCCATGCTGAGTGAGAGCTGTGAACCAAGACGCAGTATTATTGGGTAAACCTTGGGGTCG - 1500
    - A  M  L  S  E  S  C  E  P  R  R  S  I  I  G  *  T  L  G  S
    - P  C  *  V  R  A  V  N  Q  D  A  V  L  L  G  K  P  W  G  R
    - H  A  E  *  E  L  *  T  K  T  Q  Y  Y  W  V  N  L  G  V  G
1501 - GCGCTGTTTTGGCCTTGCCCCATTGCGTCCTCCATTCTGGTTATTGTCAGTTGAATCTGT - 1560
    - A  L  F  W  P  C  P  I  A  S  S  I  L  V  I  V  S  *  I  C
    - R  C  F  G  L  A  P  L  R  P  P  F  W  L  L  S  V  E  S  V
    - A  V  L  A  L  P  H  C  V  L  H  S  G  Y  C  Q  L  N  L  W
1561 - GGGTCCACCAAATGTAATGCGGGGGGCACTACGTTGGTTTGATTGGGGTCCATTATCAGA - 1620
    - G  S  T  K  C  N  A  G  G  T  T  L  V  *  L  G  S  I  I  R
    - G  P  P  N  V  M  R  G  A  L  R  W  F  D  W  G  P  L  S  D
    - V  H  Q  M  *  C  G  G  H  Y  V  G  L  I  G  V  H  Y  Q  T
1621 - CATTTTAATTTGTTCGTTTATTTAAAACAACAAGTACGTCTCTAAATGCAGCAGTTTGGT - 1680
    - H  F  N  L  F  V  Y  L  K  Q  Q  V  R  L  *  M  Q  Q  F  G
    - I  L  I  C  S  F  I  *  N  N  K  Y  V  S  K  C  S  S  L  V
    - F  *  F  V  R  L  F  K  T  T  S  T  S  L  N  A  A  V  W  *
```

FIG. 12 Con't

```
1681 - GACCTTCATGAAGGTACCAACACCTAGCTATAAGCGCACCACCAGCTGGATCTTGACAGT - 1740
     -  D   L   H   E   G   T   N   T   *   L   *   A   H   H   Q   L   D   L   D   S
     -    T   F   M   K   V   P   T   P   S   Y   K   R   T   T   S   W   I   L   T   V
     -      P   S   *   R   Y   Q   H   L   A   I   S   A   P   P   A   G   S   *   Q   L
1741 - TGATAGTAACATTAGGTGTGCATGTTTGAACCATAGTGTGCCATCTATGAAAAGGTAAAA - 1800
     -  *   *   *   H   *   V   C   M   F   E   P   *   C   A   I   Y   E   K   V   K
     -    D   S   N   I   R   C   A   C   L   N   H   S   V   P   S   M   K   R   *   N
     -      I   V   T   L   G   V   H   V   *   T   I   V   C   H   L   *   K   G   K   T
1801 - CCTTTCCTAGAGCACAAAGCCAAGCAGTGCTATAAGTATTACCCCTAGTGTTGTACCTTA - 1860
     -  P   F   L   E   H   K   A   K   Q   C   Y   K   Y   Y   P   *   C   C   T   L
     -    L   S   *   S   T   K   P   S   S   A   I   S   I   T   P   S   V   V   P   Y
     -      F   P   R   A   Q   S   Q   A   V   L   *   V   L   P   L   V   L   Y   L   T
1861 - CAAGGATCTTCAAGCACATGAGGTTTATTAGATGCACAGCGCTGTACTACAGTGCATATG - 1920
     -  Q   G   S   S   S   T   *   G   L   L   D   A   Q   R   C   T   T   V   H   M
     -    K   D   L   Q   A   H   E   V   Y   *   M   H   S   A   V   L   Q   C   I   C
     -      R   I   F   K   H   M   R   F   I   R   C   T   A   L   Y   Y   S   A   Y   A
1921 - CAACTGCATAGAGAAATACAAGTCAAAACAATGAGAAGTTTCATGTTCGTTTAGACTTTG - 1980
     -  Q   L   H   R   E   I   Q   V   K   T   M   R   S   F   M   F   V   *   T   L
     -    N   C   I   E   K   Y   K   S   K   Q   *   E   V   S   C   S   F   R   L   W
     -      T   A   *   R   N   T   S   Q   N   N   E   K   F   H   V   R   L   D   F   G
1981 - GTACAAGGTTCTTCTAGATCCTGGATTTCGAGTGAAAACCAAAATATAATAAGCATTATT - 2040
     -  V   Q   G   S   S   R   S   W   I   S   S   E   N   Q   N   I   I   S   I   I
     -    Y   K   V   L   L   D   P   G   F   R   V   K   T   K   I   *   *   A   L   L
     -      T   R   F   F   *   I   L   D   F   E   *   K   P   K   Y   N   K   H   Y   *
2041 - AAAACAAGGAATAGCAGAAAGGCTAAAAAGCACAAATAGAAGTCAATTAAAGTGAGCTCA - 2100
     -  K   T   R   N   S   R   K   A   K   K   H   K   *   K   S   I   K   V   S   S
     -    K   Q   G   I   A   E   R   L   K   S   T   N   R   S   Q   L   K   *   A   H
     -      N   K   E   *   Q   K   G   *   K   A   Q   I   E   V   N   *   S   E   L   I
2101 - TTCATTCTGTCTTTCTCTTAATGGTGAAGCAAAGTATTAAAAATACTAGAGCAGCAACAA - 2160
     -  F   I   L   S   F   S   *   W   *   S   K   V   L   K   I   L   E   Q   Q   Q
     -    S   F   C   L   S   L   N   G   E   A   K   Y   *   K   Y   *   S   S   N   N
     -      H   S   V   F   L   L   M   V   K   Q   S   I   K   N   T   R   A   A   T   M
2161 - TGAGAAAAAGTGGCGAGTAGAGCTCTTGTTGAACCTCCTCTTGTCTGATGAAAAGTTTTG - 2220
     -  *   E   K   V   A   S   R   A   L   V   E   P   P   L   V   *   *   K   V   L
     -    E   K   K   W   R   V   E   L   L   L   N   L   L   L   S   D   E   K   F   W
     -      R   K   S   G   E   *   S   S   C   *   T   S   S   C   L   M   K   S   F   G
2221 - GTGAAACTGATCTTGCACGCAGCTGATAGGTATGTCGAGTACCGTCAGCACAAGCAAAAG - 2280
     -  V   K   L   I   L   H   A   A   D   R   Y   V   E   Y   R   Q   H   K   Q   K
     -    *   N   *   S   C   T   Q   L   I   G   M   S   S   T   V   S   T   S   K   S
     -      E   T   D   L   A   R   S   *   *   V   C   R   V   P   S   A   Q   A   K   A
2281 - CAAAGTGTGTGCTAGTGCAAGTTAGTGCAAATTTATTGTCAGCAAGAGGGTGAAATGGTG - 2340
     -  Q   S   V   C   *   C   K   L   V   Q   I   Y   C   Q   Q   E   G   E   M   V
     -    K   V   C   A   S   A   S   *   C   K   F   I   V   S   K   R   V   K   W   *
     -      K   C   V   L   V   Q   V   S   A   N   L   L   S   A   R   G   *   N   G   E
2341 - AATTGCCCTCGTATGTTCCTGATGGGCAAGGTTCTTTTAGTAGTACAGTCGTACCTCTAA - 2400
     -  N   C   P   R   M   F   L   M   G   K   V   L   L   V   V   Q   S   Y   L   *
     -    I   A   L   V   C   S   *   W   A   R   F   F   *   *   Y   S   R   T   S   N
     -      L   P   S   Y   V   P   D   G   Q   G   S   F   S   S   T   V   V   P   L   T
2401 - CACACTCCTGATAGTGATATAGCTCGCAAGATGTAAATACAATCAATGTCAGGAAGAGAA - 2460
     -  H   T   P   D   S   D   I   A   R   K   M   *   I   Q   S   M   S   G   R   E
     -    T   L   L   I   V   I   *   L   A   R   C   K   Y   N   Q   C   Q   E   E   N
     -      H   S   *   *   *   Y   S   S   Q   D   V   N   T   I   N   V   R   K   R   I
2461 - TAATTTTCATGTTCGTTTTATGGATAATCTAACTCCATAGGTTCTTCATCATCTAACTCC - 2520
     -  *   F   S   C   S   F   Y   G   *   S   N   S   I   G   S   S   S   S   N   S
     -    N   F   H   V   R   F   M   D   N   L   T   P   *   V   L   H   H   L   T   P
     -      I   F   M   F   V   L   W   I   I   *   L   H   R   F   F   I   I   *   L   R
```

FIG. 12 Con't

```
2521 - GAATAATTCTTCTTAGTTAGAGGCTTAAATAATTGTCTCACTATTGAACTTATTATAACG - 2580
     - E  *  F  F  L  V  R  G  L  N  N  C  L  T  I  E  L  I  I  T
     -  N  N  S  S  *  L  E  A  *  I  I  V  S  L  L  N  L  L  *  R
     -   I  I  L  L  S  *  R  L  K  *  L  S  H  Y  *  T  Y  Y  N  V
2581 - TCAAGATTCCAAATAGCAATCCTGAAAGTCCTCATAATGATAATCAATATCTCTGCTATT - 2640
     - S  R  F  Q  I  A  I  L  K  V  L  I  M  I  I  N  I  S  A  I
     -  Q  D  S  K  *  Q  S  *  K  S  S  *  *  *  S  I  S  L  L
     -   K  I  P  N  S  N  P  E  S  P  H  N  D  N  Q  Y  L  C  Y  C
2641 - GTAACCTGGAAGTCAACAAGATGAAACATCTGTTGTCACTTACTGTACTAGCAAAGCAAT - 2700
     - V  T  W  K  S  T  R  *  N  I  C  C  H  L  L  Y  *  Q  S  N
     -  *  P  G  S  Q  Q  D  E  T  S  V  V  T  Y  C  T  S  K  A  I
     -   N  L  E  V  N  K  M  K  H  L  L  S  L  T  V  L  A  K  Q  Y
2701 - ATTGTCGTTGCTACCGGCGTGGTCTGTATTTAATTTATAGTTTCCAATACGGTAGCGGTT - 2760
     - I  V  V  A  T  G  V  V  C  I  *  F  I  V  S  N  T  V  A  V
     -  L  S  L  L  P  A  W  S  V  F  N  L  *  F  P  I  R  *  R  L
     -   C  R  C  Y  R  R  G  L  Y  L  I  Y  S  F  Q  Y  G  S  G  C
2761 - GTATGCAGCAAAACCTGAATCAGTGCCTACACGCTGCGACGCTCCTAATTTGTAATAAGA - 2820
     - V  C  S  K  T  *  I  S  A  Y  T  L  R  R  S  *  F  V  I  R
     -  Y  A  A  K  P  E  S  V  P  T  R  C  D  A  P  N  L  *  *  E
     -   M  Q  Q  N  L  N  Q  C  L  H  A  A  T  L  L  I  C  N  K  K
2821 - AAGCGTTCGTGATGTAGCCACAGTGATCTCTTTTGGCAGGTCCTTAATGTCACAGCGCCC - 2880
     - K  R  S  *  C  S  H  S  D  L  F  W  Q  V  L  N  V  T  A  P
     -  S  V  R  D  V  A  T  V  I  S  F  G  R  S  L  M  S  Q  R  P
     -   A  F  V  M  *  P  Q  *  S  L  L  A  G  P  *  C  H  S  A  L
2881 - TAGGGAGTGTCCGGCCATTCGCAAGTGACCACGAATGATCACAGCACCAATGACAAGTTC - 2940
     - *  G  V  S  G  H  S  Q  V  T  T  N  D  H  S  T  N  D  K  F
     -  R  E  C  P  A  I  R  K  *  P  R  M  I  T  A  P  M  T  S  S
     -   G  S  V  R  P  F  A  S  D  H  E  *  S  Q  H  Q  *  Q  V  H
2941 - ACTTTCCATGAGCGGTCTGGTCACAATTGTCCCCCGGAGAGGCACATTGAGAAGAATGTT - 3000
     - T  F  H  E  R  S  G  H  N  C  P  P  E  R  H  I  E  K  N  V
     -  L  S  M  S  G  L  V  T  I  V  P  R  R  G  T  L  R  R  M  F
     -   F  P  *  A  V  W  S  Q  L  S  P  G  E  A  H  *  E  E  C  L
3001 - TGTTTCTGGGTTGAATGACCACATTGAGCGGGTACGAGCAAACAGCCTGAAGGAAGCAAC - 3060
     - C  F  W  V  E  *  P  H  *  A  G  T  S  K  Q  P  E  G  S  N
     -  V  S  G  L  N  D  H  I  E  R  V  R  A  N  S  L  K  E  A  T
     -   F  L  G  *  M  T  T  L  S  G  Y  E  Q  T  A  *  R  K  Q  R
3061 - GAAGTAGCTAAGCCACATCAAGCCTACAATACAAGCCATTGCAATCGCAATCCCGCCAGT - 3120
     - E  V  A  K  P  H  Q  A  Y  N  T  S  H  C  N  R  N  P  A  S
     -  K  *  L  S  H  I  K  P  T  I  Q  A  I  A  I  A  I  P  P  V
     -   S  S  *  A  T  S  S  L  Q  Y  K  P  L  Q  S  Q  S  R  Q  S
3121 - CACCCAATTAATTCTGTAGACAACAGCAAGCACAAAACAAGCAAGTGTTACTGGCCACAA - 3180
     - H  P  I  N  S  V  D  N  S  K  H  K  T  S  K  C  Y  W  P  Q
     -  T  Q  L  I  L  *  T  T  A  S  T  K  Q  A  S  V  T  G  H  K
     -   P  N  *  F  C  R  Q  Q  Q  A  Q  N  K  Q  V  L  L  A  T  R
3181 - GAGCCAGAGGAAAACAAGCTTTATTATGTACAAAAACCTGTTCCGATTAGAATAGGCAAA - 3240
     - E  P  E  E  N  K  L  Y  Y  V  Q  K  P  V  P  I  R  I  G  K
     -  S  Q  R  K  T  S  F  I  M  Y  K  N  L  F  R  L  E  *  A  N
     -   A  R  G  K  Q  A  L  L  C  T  K  T  C  S  D  *  N  R  Q  I
3241 - TTGTAGTAACATAATCCAGGCTAGGAATAGGAAACCTATTACTAGGTTCCATTGTTCCAG - 3300
     - L  *  *  H  N  P  G  *  E  *  E  T  Y  Y  *  V  P  L  F  Q
     -  C  S  N  I  I  Q  A  R  N  R  K  P  I  T  R  F  H  C  S  R
     -   V  V  T  *  S  R  L  G  I  G  N  L  L  L  G  S  I  V  P  G
3301 - GAGTTGTTTAAGCTCCTCAACGGTAATAGTACCGTTGTCTGCCATGATAAGCAATGTTAA - 3360
     - E  L  F  K  L  L  N  G  N  S  T  V  V  C  H  D  K  Q  C  *
     -  S  C  L  S  S  S  T  V  I  V  P  L  S  A  M  I  S  N  V  K
     -   V  V  *  A  P  Q  R  *  *  Y  R  C  L  P  *  *  A  M  L  K
```

FIG. 12 Con't

```
3361 - AGTTCCAAACAGAATAATAATAATAGTTAGTTCGTTTAGACCAGAAGATCAGGAACTCCT - 3420
     - S  S  K  Q  N  N  N  N  S  *  F  V  *  T  R  R  S  G  T  P
     -  V  P  N  R  I  I  I  I  V  S  S  F  R  P  E  D  Q  E  L  L
     -   F  Q  T  E  *  *  *  *  L  V  R  L  D  Q  K  I  R  N  S  F
3421 - TCAGAAGAGTTCAGATTTTTAACACGCGAGTAGACGTAAACCGTTGGTTTTACTAAACTC - 3480
     - S  E  E  F  R  F  L  T  R  E  *  T  *  T  V  G  F  T  K  L
     -  Q  K  S  S  D  F  *  H  A  S  R  R  K  P  L  V  L  L  N  S
     -   R  R  V  Q  I  F  N  T  R  V  D  V  N  R  W  F  Y  *  T  H
3481 - ACGTTAACAATATTGCAGCAGTACGCACACAATCGAAGCGCAGTAAGGATGGCTAGTGTG - 3540
     - T  L  T  I  L  Q  Q  Y  A  H  N  R  S  A  V  R  M  A  S  V
     -  R  *  Q  Y  C  S  S  T  H  T  I  E  A  Q  *  G  W  L  V  *
     -   V  N  N  I  A  A  V  R  T  Q  S  K  R  S  K  D  G  *  C  D
3541 - ACTAGCAAGAATACCACGAAAGCAAGAAAAAGAAGTACGCTATTAACTATTAACGTACCT - 3600
     - T  S  K  N  T  T  K  A  R  K  R  S  T  L  L  T  I  N  V  P
     -  L  A  R  I  P  R  K  Q  E  K  E  V  R  Y  *  L  L  T  Y  L
     -   *  Q  E  Y  H  E  S  K  K  K  K  Y  A  I  N  Y  *  R  T  C
3601 - GTTTCTTCCGAAACGAATGAGTACATAAGTTCGTACTCACTTTCTTGTGCTTACAAAGGC - 3660
     - V  S  S  E  T  N  E  Y  I  S  S  Y  S  L  S  C  A  Y  K  G
     -  F  L  P  K  R  M  S  T  *  V  R  T  H  F  L  V  L  T  K  A
     -   F  F  R  N  E  *  V  H  K  F  V  L  T  F  L  C  L  Q  R  H
3661 - ACGCTAGTAGTCGTCGTCGGCTCATCATAAATTGGATCCATTGCTGGATTAGCAACTCCT - 3720
     - T  L  V  V  V  V  G  S  S  *  I  G  S  I  A  G  L  A  T  P
     -  R  *  *  S  S  S  A  H  H  K  L  D  P  L  L  D  *  Q  L  L
     -   A  S  S  R  R  R  L  I  I  N  W  I  H  C  W  I  S  N  S  *
3721 - GAAGAGCCGTCGATTGTGTGTATTTGCACATTCGGTGGGTCTTTAACAAGCTTGTTAAAG - 3780
     - E  E  P  S  I  V  C  I  C  T  F  G  G  S  L  T  S  L  L  K
     -  K  S  R  R  L  C  V  F  A  H  S  V  G  L  *  Q  A  C  *  R
     -   R  A  V  D  C  V  Y  L  H  I  R  W  V  F  N  K  L  V  K  D
3781 - ATGAAGAATGTAGCATTTTCAATACCAGTGTCTGTAGTAATTTGTGTAGACTCAAGCTGG - 3840
     - M  K  N  V  A  F  S  I  P  V  S  V  V  I  C  V  D  S  S  W
     -  *  R  M  *  H  F  Q  Y  Q  C  L  *  *  F  V  *  T  Q  A  G
     -   E  E  C  S  I  F  N  T  S  V  C  S  N  L  C  R  L  K  L  V
3841 - TAGTAAACTTCGGTGAAATAGCCATGTACAACGACATAGTCTTTAACACCTGAGTGCCTA - 3900
     - *  *  T  S  V  K  *  P  C  T  T  T  *  S  L  T  P  E  C  L
     -  S  K  L  R  *  N  S  H  V  Q  R  H  S  L  *  H  L  S  A  Y
     -   V  N  F  G  E  I  A  M  Y  N  D  I  V  F  N  T  *  V  P  I
3901 - TCCTCAGAATAACCACCAATTTGGTAGTCTTCTTTGAGTTTTGGTGTTGAAATGCCGTCA - 3960
     - S  S  E  *  P  P  I  W  *  S  S  L  S  F  G  V  E  M  P  S
     -  P  Q  N  N  H  Q  F  G  S  L  L  *  V  L  V  L  K  C  R  H
     -   L  R  I  T  T  N  L  V  V  F  F  E  F  W  C  *  N  A  V  T
3961 - CCTTCAGTAACGACAATTGTATCTGTGACACTGTTATATGGTATACAGTAGTCATAGTTA - 4020
     - P  S  V  T  T  I  V  S  V  T  L  L  Y  G  I  Q  *  S  *  L
     -  L  Q  *  R  Q  L  Y  L  *  H  C  Y  M  V  Y  S  S  H  S  Y
     -   F  S  N  D  N  C  I  C  D  T  V  I  W  Y  T  V  V  I  V  M
4021 - TGTGTGTGCCAGCAAACAAAGTAGTTGGCATCATAAAGTAATGGGTTCTTGGATTTGCAC - 4080
     - C  V  C  Q  Q  T  K  *  L  A  S  *  S  N  G  F  L  D  L  H
     -  V  C  A  S  K  Q  S  S  W  H  H  K  V  M  G  S  W  I  C  T
     -   C  V  P  A  N  K  V  V  G  I  I  K  *  W  V  L  G  F  A  L
4081 - TTCCAACAAAGCCAACATCTCATAATAATTCTACATGCGTTGATGCATTGTAGAAAATAT - 4140
     - F  Q  Q  S  Q  H  L  I  I  I  L  H  A  L  M  H  C  R  K  Y
     -  S  N  K  A  N  I  S  *  *  F  Y  M  R  *  C  I  V  E  N  I
     -   P  T  K  P  T  S  H  N  N  S  T  C  V  D  A  L  *  K  I  Y
4141 - ATCAAGGCATAGAGGTACAAAAATTGCGCCTCCTTACCTGCAGCGACAAGCAAAAGATGT - 4200
     - I  K  A  *  R  Y  K  N  C  A  S  L  P  A  A  T  S  K  R  C
     -  S  R  H  R  G  T  K  I  A  P  P  Y  L  Q  R  Q  A  K  D  V
     -   Q  G  I  E  V  Q  K  L  R  L  L  T  C  S  D  K  Q  K  M  *
```

FIG. 12 Con't

```
4201 - GAATAGATGGTAACAAATAGCAGCAGTAAATTGCAAATGAACTGGAAGCCCTTATAAGG - 4260
     - E * M V T N S S S K L Q M N W K P L * R
     - N R W * Q I A A V N C K * T G S P Y K G
     - I D G N K * Q Q * I A N E L E A L I K G
4261 - GCTAGCTGCCATCTTTTATTGAGCGCAATTATTTTGGTAGCGCTCTGAAAAACAGCAAGA - 4320
     - A S C H L L L S A I I L V A L * K T A R
     - L A A I F Y * A Q L F W * R S E K Q Q E
     - * L P S F I E R N Y F G S A L K N S K K
4321 - AATGCAACGCCAATAACAAGCCATCCGAAAGGGAGTGAGGCTTGTAGCGGTATCGTTGCT - 4380
     - N A T P I T S H P K G S E A C S G I V A
     - M Q R Q * Q A I R K G V R L V A V S L L
     - C N A N N K P S E R E * G L * R Y R C C
4381 - GTAGCATGAACAGTACTTGCAGGAGAAGCATTGTCAATTTTACTGGCTGTGCAGTAATT - 4440
     - V A * T V L A G E A L S I F T G C A V I
     - * H E Q Y L Q E K H C Q F L L A V Q * L
     - S M N S T C R R S I V N F Y W L C S N *
4441 - GATCCAAGAGTAAAAAATCTCATAAACAAATCCATAAGTTCGTTTATGTGTAATGTAATT - 4500
     - D P R V K N L I N K S I S S F M C N V I
     - I Q E * K I S * T N P * V R L C V M * F
     - S K S K K S H K Q I H K F V Y V * C N L
4501 - TGACACCCTTGAGAACTGGCTCAGAGTCATCCTCATCAAACTTGCAGCAAGAACCACAAG - 4560
     - * H P * E L A Q S H P H Q T C S K N H K
     - D T L E N W L R V I L I K L A A R T T R
     - T P L R T G S E S S S S N L Q Q E P Q E
4561 - AGCATGCACCCTTGAGGCAACTGCAACAACTAGTCATGCAACAAAGCAAGATTGTAACCA - 4620
     - S M H P * G N C N N * S C N K A R L * P
     - A C T L E A T A T T S H A T K Q D C N H
     - H A P L R Q L Q Q L V M Q Q S K I V T M
4621 - TGACGATGGCAATTAGTCCAGCAATGAAGCCGAGCCAAACATACCAAGGCCATTTAATAT - 4680
     - * R W Q L V Q Q * S R A K H T K A I * Y
     - D D G N * S S N E A E P N I P R P F N I
     - T M A I S P A M K P S Q T Y Q G H L I Y
4681 - ATTGCTCATATTTTCCCAATTCTTGAAGGTCAATGAGTGATTCATTTAAATTTTTAGCGA - 4740
     - I A H I F P I L E G Q * V I H L N F * R
     - L L I F S Q F L K V N E * F I * I F S D
     - C S Y F P N S * R S M S D S F K F L A T
4741 - CCTCATTGAGGCGGTCAATTTCTTTTTGAATGTTGACGACAGAAGCGTTAATGCCTGAAA - 4800
     - P H * G G Q F L F E C * R Q K R * C L K
     - L I E A V N F F L N V D D R S V N A * N
     - S L R R S I S F * M L T T E A L M P E M
4801 - TGTCGCCAAGATCAACATCTGGTGATGTATGATTTTTGAAGTACTTGTCCAGCTCTTCTT - 4860
     - C R Q D Q H L V M Y D F * S T C P A L L
     - V A K I N I W * C M I F E V L V Q L F F
     - S P R S T S G D V * F L K Y L S S S S L
4861 - TGAATGAGTCAAGCTCAGGTTGCAGAGGATCATAAACTGTGTTGTTAATGATGCCAATAA - 4920
     - * M S Q A Q V A E D H K L C C * * C Q *
     - E * V K L R L Q R I I N C V V N D A N N
     - N E S S S G C R G S * T V L L M M P I T
4921 - CGACATCACAATTTCCTGAGACAAATGTATTGTCTGTAGTAATTATTTGTGGAGAAAAGA - 4980
     - R H H N F L R Q M Y C L * * L F V E K R
     - D I T I S * D K C I V C S N Y L W R K E
     - T S Q F P E T N V L S V V I I C G E K K
4981 - AGTTCCTCTGTGTAATAAACCAAGAAGTGCCATTAAACACAAAAACACCTTCACGAGGGA - 5040
     - S S S V * * T K K C H * T Q K H L H E G
     - V P L C N K P R S A I K H K N T F T R E
     - F L C V I N Q E V P L N T K T P S R G K
```

FIG. 12 Con't

```
5041 - AGTATGCTTTGCCTTCATGACAAATTGCTGGCGCTGTGGTGAAGTTCCTCTCCTGGGATG - 5100
     - S  M  L  C  L  H  D  K  L  L  A  L  W  *  S  S  S  P  G  M
     -  V  C  F  A  F  M  T  N  C  W  R  C  G  E  V  P  L  L  G  W
     -   Y  A  L  P  S  *  Q  I  A  G  A  V  V  K  F  L  S  W  D  G
5101 - GCACATACGTGACATGTAGGAAGACAACACCATGCGGGCTGCTTGTGGGAAGGACATAA - 5160
     - A  H  T  *  H  V  G  R  Q  H  H  A  G  L  L  V  G  R  T  *
     -  H  I  R  D  M  *  E  D  N  T  M  R  G  C  L  W  E  G  H  K
     -   T  Y  V  T  C  R  K  T  T  P  C  G  A  A  C  G  K  D  I  R
5161 - GGTGGTAGCCCTTTCCACAAAAGTCAACTCTTTTTGATTGTCCAAGAACACACTCAGACA - 5220
     - G  G  S  P  F  H  K  S  Q  L  F  L  I  V  Q  E  H  T  Q  T
     -  V  V  A  L  S  T  K  V  N  S  F  *  L  S  K  N  T  L  R  H
     -   W  *  P  F  P  Q  K  S  T  L  F  D  C  P  R  T  H  S  D  I
5221 - TTTTAGTAGCAGCAAGATTAGCAGAAGCCCTGATTTCAGCAGCCCTGATTAGTTGTTGTG - 5280
     - F  *  *  Q  Q  D  *  Q  K  P  *  F  Q  Q  P  *  L  V  V  V
     -  F  S  S  S  K  I  S  R  S  P  D  F  S  S  P  D  *  L  L  C
     -   L  V  A  A  R  L  A  E  A  L  I  S  A  A  L  I  S  C  C  V
5281 - TTACATAGGTTTGAAGGCTTTGAAGTCTGCCTGTAATTAACCTGTCAATTTGTACCTCCG - 5340
     - L  H  R  F  E  G  F  E  V  C  L  *  L  T  C  Q  F  V  P  P
     -  Y  I  G  L  K  A  L  K  S  A  C  N  *  P  V  N  L  Y  L  R
     -   T  *  V  *  R  L  *  S  L  P  V  I  N  L  S  I  C  T  S  A
5341 - CCTCGACTTTATCAAGTCGCGAAAGGATATCATTTAGCACACTTGAAATTGCACCAAAAT - 5400
     - P  R  L  Y  Q  V  A  K  G  Y  H  L  A  H  L  K  L  H  Q  N
     -  L  D  F  I  K  S  R  K  D  I  I  *  H  T  *  N  C  T  K  I
     -   S  T  L  S  S  R  E  R  I  S  F  S  T  L  E  I  A  P  K  L
5401 - TAGAGCTAAGTTGTTTAACAAGTGTGTTTAATGCTTGAGCATTCTGGTTAACAACGTCTT - 5460
     - *  S  *  V  V  *  Q  V  C  L  M  L  E  H  S  G  *  Q  R  L
     -  R  A  K  L  F  N  K  C  V  *  C  L  S  I  L  V  N  N  V  L
     -   E  L  S  C  L  T  S  V  F  N  A  *  A  F  W  L  T  T  S  C
5461 - GCAGCTTGCCCAATGCAGTTGATGTTGTTGTAAGTGATTCTTGAATTTGACTAATCGCCT - 5520
     - A  A  C  P  M  Q  L  M  L  L  *  V  I  L  E  F  D  *  S  P
     -  Q  L  A  Q  C  S  *  C  C  C  K  *  F  L  N  L  T  N  R  L
     -   S  L  P  N  A  V  D  V  V  V  S  D  S  *  I  *  L  I  A  L
5521 - TGTTAAATTGGTTGGCGATTTGTTTTTGGTTCTCATAGAGAACATTTTGGGTAACTCCAA - 5580
     - C  *  I  G  W  R  F  V  F  G  S  H  R  E  H  F  G  *  L  Q
     -  V  K  L  V  G  D  L  F  L  V  L  I  E  N  I  L  G  N  S  N
     -   L  N  W  L  A  I  C  F  W  F  S  *  R  T  F  W  V  T  P  M
5581 - TGCCATTGAACCTATATGCCATTTGCATAGCAAAAGGTATTTGAAGAGCAGCGCCAGCAC - 5640
     - C  H  *  T  Y  M  P  F  A  *  Q  K  V  F  E  E  Q  R  Q  H
     -  A  I  E  P  I  C  H  L  H  S  K  R  Y  L  K  S  S  A  S  T
     -   P  L  N  L  Y  A  I  C  I  A  K  G  I  *  R  A  A  P  A  P
5641 - CAAATGTCCATCCAGCAGTGGCAGTACCACTAACTAGAGCAGCAGTGTAGGCAGCAATCA - 5700
     - Q  M  S  I  Q  Q  W  Q  Y  H  *  L  E  Q  Q  C  R  Q  Q  S
     -  K  C  P  S  S  S  G  S  T  T  N  *  S  S  S  V  G  S  N  H
     -   N  V  H  P  A  V  A  V  P  L  T  R  A  A  V  *  A  A  I  I
5701 - TATCATCAGTGAGCAGAGGTGGCAACACTGTAAGTCCATTGAACTTCTGCGCACAAATGA - 5760
     - Y  H  Q  *  A  E  V  A  T  L  *  V  H  *  T  S  A  H  K  *
     -  I  I  S  E  Q  R  W  Q  H  C  K  S  I  E  L  L  R  T  N  E
     -   S  S  V  S  R  G  G  N  T  V  S  P  L  N  F  C  A  Q  M  R
5761 - GATCTCTAGCATTAATATCACCTAGGCATTCGCCATATTGCTTCATGAAGCCAGCATCAG - 5820
     - D  L  *  H  *  Y  H  L  G  I  R  H  I  A  S  *  S  Q  H  Q
     -  I  S  S  I  N  I  T  *  A  F  A  I  L  L  H  E  A  S  I  S
     -   S  L  A  L  I  S  P  R  H  S  P  Y  C  F  M  K  P  A  S  A
5821 - CGAGTGTCACCTTATTAAAGAGCAAGTCCTCAATAAAAGACCTCTTAGTTGGCTTTAGAG - 5880
     - R  V  S  P  Y  *  R  A  S  P  Q  *  K  T  S  *  L  A  L  E
     -  E  C  H  L  I  K  E  Q  V  L  N  K  R  P  L  S  W  L  *  R
     -   S  V  T  L  L  K  S  K  S  S  I  K  D  L  L  V  G  F  R  G
```

FIG. 12 Con't

```
5881 - GGTCAGGTAATATTTGTGAAAAATTAAAACCACCAAAATATTTCAAAGTTGGGGTTTTGT - 5940
     - G  Q  V  I  F  V  K  N  *  N  H  Q  N  I  S  K  L  G  F  C
     - V  R  *  Y  L  *  K  I  K  T  T  K  I  F  Q  S  W  G  F  V
     - S  G  N  I  C  E  K  L  K  P  P  K  Y  F  K  V  G  V  L  Y
5941 - ACATTTGTTTGACTTGAGCGAACACTTCACGTGTGTTGCGATCCTGTTCAGCAGCAATAC - 6000
     - T  F  V  *  L  E  R  T  L  H  V  C  C  D  P  V  Q  Q  Q  Y
     - H  L  F  D  L  S  E  H  F  T  C  V  A  I  L  F  S  S  N  T
     - I  C  L  T  *  A  N  T  S  R  V  L  R  S  C  S  A  A  I  P
6001 - CTGAGAGTGCACGATTTAGTTGTGTGCAAAAGCTACCATATTGGAGAAGCAAATTAGCAC - 6060
     - L  R  V  H  D  L  V  V  C  K  S  Y  H  I  G  E  A  N  *  H
     - *  E  C  T  I  *  L  C  A  K  A  T  I  L  E  K  Q  I  S  T
     - E  S  A  R  F  S  C  V  Q  K  L  P  Y  W  R  S  K  L  A  H
6061 - ATTCAGTAGAATCTCCGCAGATGTACATATTACAATCTACGGAGGTTTTAGCCATAGAAA - 6120
     - I  Q  *  N  L  R  R  C  T  Y  Y  N  L  R  R  F  *  P  *  K
     - F  S  R  I  S  A  D  V  H  I  T  I  Y  G  G  F  S  H  R  N
     - S  V  E  S  P  Q  M  Y  I  L  Q  S  T  E  V  L  A  I  E  T
6121 - CAGGCATTACTTCTGTAGTAATGCTAATTGAAAAGTTAGTAGGTATAGCAATGGTGTTAT - 6180
     - Q  A  L  L  L  *  *  C  *  L  K  S  *  *  V  *  Q  W  C  Y
     - R  H  Y  F  C  S  N  A  N  *  K  V  S  R  Y  S  N  G  V  I
     - G  I  T  S  V  V  M  L  I  E  K  L  V  G  I  A  M  V  L  L
6181 - TAGAGTAAGCAATTGAACTATCAGCACCTAAAGACATAGTATAAGCCACAATAGATTTTT - 6240
     - *  S  K  Q  L  N  Y  Q  H  L  K  T  *  Y  K  P  Q  *  I  F
     - R  V  S  N  *  T  I  S  T  *  R  H  S  I  S  H  N  R  F  L
     - E  *  A  I  E  L  S  A  P  K  D  I  V  *  A  T  I  D  F  W
6241 - GGCTAGTACTACGTAATAAAGAAACTGTATGGTAACTAGCACAAATGCCAGCTCCAATAG - 6300
     - G  *  Y  Y  V  I  K  K  L  Y  G  N  *  H  K  C  Q  L  Q  *
     - A  S  T  T  *  *  R  N  C  M  V  T  S  T  N  A  S  S  N  R
     - L  V  L  R  N  K  E  T  V  W  *  L  A  Q  M  P  A  P  I  G
6301 - GAATGTCGCACTCATAAGAAGTGTCGACATGCTCAGCTCCTATAAGACAGCCTGCTTGAG - 6360
     - E  C  R  T  H  K  K  C  R  H  A  Q  L  L  *  D  S  L  L  E
     - N  V  A  L  I  R  S  V  D  M  L  S  S  Y  K  T  A  C  L  S
     - M  S  H  S  *  E  V  S  T  C  S  A  P  I  R  Q  P  A  *  V
6361 - TCTGGAATACATTGTTTCCAGTAGAATATATGCGCCAAGCTGGTGTGAGTTGATCTGCAT - 6420
     - S  G  I  H  C  F  Q  *  N  I  C  A  K  L  V  *  V  D  L  H
     - L  E  Y  I  V  S  S  R  I  Y  A  P  S  W  C  E  L  I  C  M
     - W  N  T  L  F  P  V  E  Y  M  R  Q  A  G  V  S  *  S  A  *
6421 - GAATTGCTGTAGAAACATCAGTGCAGTTAACATCTTGATATAGAACAGCAACTTCAGATG - 6480
     - E  L  L  *  K  H  Q  C  S  *  H  L  D  I  E  Q  Q  L  Q  M
     - N  C  C  R  N  I  S  A  V  N  I  L  I  *  N  S  N  F  R  *
     - I  A  V  E  T  S  V  Q  L  T  S  *  Y  R  T  A  T  S  D  E
6481 - AAGCATTTGTTCCAGGTGTAATTACACTTACACCCCCAAAAGAGCAAGGTGAAATGTCTA - 6540
     - K  H  L  F  Q  V  *  L  H  L  H  P  Q  K  S  K  V  K  C  L
     - S  I  C  S  R  C  N  Y  T  Y  T  P  K  R  A  R  *  N  V  *
     - A  F  V  P  G  V  I  T  L  T  P  P  K  E  Q  G  E  M  S  N
6541 - ATATTTCAGATGTTTTAGGATCTCGAACGGAATCAGTGAAATCAGAAACATCACGGCCAA - 6600
     - I  F  Q  M  F  *  D  L  E  R  N  Q  *  N  Q  K  H  H  G  Q
     - Y  F  R  C  F  R  I  S  N  G  I  S  E  I  R  N  I  T  A  K
     - I  S  D  V  L  G  S  R  T  E  S  V  K  S  E  T  S  R  P  N
6601 - ATTGTTGAAATGGTTGAAATCTCTTTGAAGAAGGAGTTAACACACCAGTACCAGTGAGTC - 6660
     - I  V  E  M  V  E  I  S  L  K  K  E  L  T  H  Q  Y  Q  *  V
     - L  L  K  W  L  K  S  L  *  R  R  S  *  H  T  S  T  S  E  S
     - C  *  N  G  *  N  L  F  E  E  G  V  N  T  P  V  P  V  S  P
6661 - CATTAAAATTAAAATTGACACACTGGTTCTTAATAAGGTCAGTGGATAATTTTGGTCCAC - 6720
     - H  *  N  *  N  *  H  T  G  S  *  *  G  Q  W  I  I  L  V  H
     - I  K  I  K  I  D  T  L  V  L  N  K  V  S  G  *  F  W  S  T
     - L  K  L  K  L  T  H  W  F  L  I  R  S  V  D  N  F  G  P  Q
```

FIG. 12 Con't

```
6721 - AAACCGTGGCCGGTGCATTTAAAAGTTCAAAAGAAAGTACTACAACTCTGTAAGGTTGGT - 6780
     - K  P  W  P  V  H  L  K  V  Q  K  K  V  L  Q  L  C  K  V  G
     - N  R  G  R  C  I  *  K  F  K  R  K  Y  Y  N  S  V  R  L  V
     - T  V  A  G  A  F  K  S  S  K  E  S  T  T  T  L  *  G  W  *
6781 - AGCCAATGCCAGTAGTGGTGTAAAAACCATAATCATTTAATGGCCAATAACAATTAAGAG - 6840
     - S  Q  C  Q  *  W  C  K  N  H  N  H  L  M  A  N  N  N  *  E
     - A  N  A  S  S  G  V  K  T  I  I  I  *  W  P  I  T  I  K  S
     - P  M  P  V  V  V  *  K  P  *  S  F  N  G  Q  *  Q  L  R  A
6841 - CAGGTGGGGTGCAAGGTTTGCCATCAGGGGAGAAAGGCACATTAGATATGTCTCTCTCAA - 6900
     - Q  V  G  C  K  V  C  H  Q  G  R  K  A  H  *  I  C  L  S  Q
     - R  W  G  A  R  F  A  I  R  G  E  R  H  I  R  Y  V  S  L  K
     - G  G  V  Q  G  L  P  S  G  E  K  G  T  L  D  M  S  L  S  K
6901 - AGGGCCTAAGCTTGCCATGTCTAAGATACCTATATTTATAATTATAATTACCAGTTGAAG - 6960
     - R  A  *  A  C  H  V  *  D  T  Y  I  Y  N  Y  N  Y  Q  L  K
     - G  P  K  L  A  M  S  K  I  P  I  F  I  I  I  I  T  S  *  S
     - G  L  S  L  P  C  L  R  Y  L  Y  L  *  L  *  L  P  V  E  V
6961 - TAGCATCAATGTTCCTAGTATTCCAAGCAAGGACACAACCCATGAAATCATCTGGCAATT - 7020
     - *  H  Q  C  S  *  Y  S  K  Q  G  H  N  P  *  N  H  L  A  I
     - S  I  N  V  P  S  I  P  S  K  D  T  T  H  E  I  I  W  Q  F
     - A  S  M  F  L  V  F  Q  A  R  T  Q  P  M  K  S  S  G  N  L
7021 - TATAATTATAATCAGCAATAACACCAGTTTGTCCTGGCGCTATTTGTCTTACATCATCTC - 7080
     - Y  N  Y  N  Q  Q  *  H  Q  F  V  L  A  L  F  V  L  H  H  L
     - I  I  I  I  S  N  N  T  S  L  S  W  R  Y  L  S  Y  I  I  S
     - *  L  *  S  A  I  T  P  V  C  P  G  A  I  C  L  T  S  S  P
7081 - CCTTGACTACAAAAGAATCTGCATAGACATTGGAGAAGCAAAGATCATTCAACTTAGTGG - 7140
     - P  *  L  Q  K  N  L  H  R  H  W  R  S  K  D  H  S  T  *  W
     - L  D  Y  K  R  I  C  I  D  I  G  E  A  K  I  I  Q  L  S  G
     - L  T  T  K  E  S  A  *  T  L  E  K  Q  R  S  F  N  L  V  A
7141 - CAGAAACGCCATAGCACTTAAAGGTTGAAAAAAATGTTGAGTTGTAGAGCACAGAGTAAT - 7200
     - Q  K  R  H  S  T  *  R  L  K  K  M  L  S  C  R  A  Q  S  N
     - R  N  A  I  A  L  K  G  *  K  K  C  *  V  V  E  H  R  V  I
     - E  T  P  *  H  L  K  V  E  K  N  V  E  L  *  S  T  E  *  S
7201 - CAGCAACACAATTAGAAATTTTTTTTCTCTCCCATGCATAGACAGAAGGGAATTTAGTAG - 7260
     - Q  Q  H  N  *  K  F  F  F  S  P  M  H  R  Q  K  G  I  *  *
     - S  N  T  I  R  N  F  F  S  L  P  C  I  D  R  R  E  F  S  S
     - A  T  Q  L  E  I  F  F  L  S  H  A  *  T  E  G  N  L  V  A
7261 - CATTAAAAACCTCTCCAAAAGGACACAAGTTTGTAATATTAGGGAATCTCACAACATCTC - 7320
     - H  *  K  P  L  Q  K  D  T  S  L  *  Y  *  G  I  S  Q  H  L
     - I  K  N  L  S  K  R  T  Q  V  C  N  I  R  E  S  H  N  I  S
     - L  K  T  S  P  K  G  H  K  F  V  I  L  G  N  L  T  T  S  P
7321 - CTGAGGGAACAACCCTGAAATTAGAGGTCTGGTAAATTCCTTTGTCAATCTCAAAGCTCT - 7380
     - L  R  E  Q  P  *  N  *  R  S  G  K  F  L  C  Q  S  Q  S  S
     - *  G  N  N  P  E  I  R  G  L  V  N  S  F  V  N  L  K  A  L
     - E  G  T  T  L  K  L  E  V  W  *  I  P  L  S  I  S  K  L  L
7381 - TAACAGAGCATTTGAGTTCAGCAAGTGGATTTTGAGAACAATCAACAGCATCTGTGATTG - 7440
     - *  Q  S  I  *  V  Q  Q  V  D  F  E  N  N  Q  Q  H  L  *  L
     - N  R  A  F  E  F  S  K  W  I  L  R  T  I  N  S  I  C  D  C
     - T  E  H  L  S  S  A  S  G  F  *  E  Q  S  T  A  S  V  I  V
7441 - TACCATTTTCATCATACTTGAGCATAAATGTAGTTGGCTTTAAATAGCCAACAAATAGG - 7500
     - Y  H  F  H  H  T  *  A  *  M  *  L  A  L  N  S  Q  Q  N  R
     - T  I  F  I  I  L  E  H  K  C  S  W  L  *  I  A  N  K  I  G
     - P  F  S  S  Y  L  S  I  N  V  V  G  F  K  *  P  T  K  *  A
7501 - CTGCAGCTGACGTGCCCCAAATGTCTTGAGCAGGTGAAAAGGCTGTAAGAATGGCTCTAA - 7560
     - L  Q  L  T  C  P  K  C  L  E  Q  V  K  R  L  *  E  W  L  *
     - C  S  *  R  A  P  N  V  L  S  R  *  K  G  C  K  N  G  S  K
     - A  A  D  V  P  Q  M  S  *  A  G  E  K  A  V  R  M  A  L  K
```

FIG. 12 Con't

```
7561 - AATTTGTAATGTTAATACCAAGAGGCAACTTAAAAATAGGTTTCAAAGTGTTAAAACCAG - 7620
     - N L * C * Y Q E A T * K * V S K C * N Q
     - I C N V N T K R Q L K N R F Q S V K T R
     - F V M L I P R G N L K I G F K V L K P E
7621 - AAGGTAGATCACGAACTACATCTATAGGTTGATAGCCCTTATAAACATAGAGAAACCCAT - 7680
     - K V D H E L H L * V D S P Y K H R E T H
     - R * I T N Y I Y R L I A L I N I E K P I
     - G R S R T T S I G * * P L * T * R N P S
7681 - CTTTATTTTTAAACACAAACTCTCGTAAGTGTTTAAAATTACCTGACTTTTCTGAAACAT - 7740
     - L Y F * T Q T L V S V * N Y L T F L K H
     - F I F K H K L S * V F K I T * L F * N I
     - L F L N T N S R K C L K L P D F S E T S
7741 - CAAGCGAAAAGGCATCAGATATGTACTCGAAAGTGCAATTAAATGCATTATCGAATATCA - 7800
     - Q A K R H Q I C T R K C N * M H Y R I S
     - K R K G I R Y V L E S A I K C I I E Y H
     - S E K A S D M Y S K V Q L N A L S N I I
7801 - TAGTATGTGTCTGTGTACCCATGGGTTTAGAAACAGCAAAGAAAGGGTTGTCACACAATT - 7860
     - * Y V S V Y P W V * K Q Q R K G C H T I
     - S M C L C T H G F R N S K E R V V T Q F
     - V C V C V P M G L E T A K K G L S H N S
7861 - CAAAGTTACATGCTCGTATAACAACATTAGTAGAATTGTTAATAATAATCACCGACTGTG - 7920
     - Q S Y M L V * Q H * * N C * * * S P T V
     - K V T C S Y N N I S R I V N N N H R L *
     - K L H A R I T T L V E L L I I T D C D
7921 - ACTTGTTGTTCATGGTAGAACCAAAAACCCAACCACGGACAACATTTGATTTCTCTGTGG - 7980
     - T C C S W * N Q K P N H G Q H L I S L W
     - L V V H G R T K N P T T D N I * F L C G
     - L L F M V E P K T Q P R T T F D F S V A
7981 - CAGCAAAATAAATACCATCCTTAAAAGGTATGACAGGGTTGCCAAACGTATGATTAATAG - 8040
     - Q Q N K Y H P * K V * Q G C Q T Y D * *
     - S K I N T I L K R Y D R V A K R M I N S
     - A K * I P S L K G M T G L P N V * L I V
8041 - TATGAAACCCTGTAACATTAGAATAAAATGGAAGAAATAAATCCTGAGTTAAATAAAGAG - 8100
     - Y E T L * H * N K M E E I N P E L N K E
     - M K P C N I R I K W K K * I L S * I K S
     - * N P V T L E * N G R N K S * V K * R V
8101 - TGTCTGATCTAAAAATTTCATCAGGATAGTAAACCCCCCTCATAGATGAAGTATGTTGAG - 8160
     - C L I * K F H Q D S K P P S * M K Y V E
     - V * S K N F I R I V N P P H R * S M L S
     - S D L K I S S G * * T P L I D E V C * V
8161 - TGTAATTAGGAGCTTGAACATCATCAAAAGTGGTGCACCGGTCAAGGTCACTACCACTAG - 8220
     - C N * E L E H H Q K W C T G Q G H Y H *
     - V I R S L N I I K S G A P V K V T T T S
     - * L G A * T S S K V V H R S R S L P L V
8221 - TGAGAGTAAGAAATAATAAGAAAATAAACATGTTCGTTTAGTTGTTAACAAGAATATCAC - 8280
     - * E * E I I R K * T C S F S C * Q E Y H
     - E S K K * * E N K H V R L V V N K N I T
     - R V R N N K K I N M F V * L L T R I S L
8281 - TTGAAACCACAACTCTGTTGTTTTCTAATGATAAGCCTACCTTTTTCCAGAAGAGAAT - 8340
     - L K P Q L C C F L * * * A Y L F P E E N
     - * N H N S V V F S N D K P T F F Q K R I
     - E T T T L L F S L M I S L P F S R R E *
8341 - AAATCATATCATTGATTTGATTCTCCTTAAGAGACATTACAGCAGTTCCTCTTAATTTAA - 8400
     - K S Y H * F D S P * E T L Q Q F L L I *
     - N H I I D L I L L K R H Y S S S * F K
     - I I S L I * F S L R D I T A V P L N L R
```

FIG. 12 Con't

```
8401 - GAGGAAATTTGCTCATGTCAAAGAGTGAATAGGAAGACAACTGGATAGGATTTGTGTTCC - 8460
     - E  E  I  C  S  Q  R  V  N  R  K  T  T  G  *  D  L  C  S
     -  R  K  F  A  H  V  K  E  *  I  G  R  Q  L  D  R  I  C  V  P
     -   G  N  L  L  M  S  K  S  E  *  E  D  N  W  I  G  F  V  F  L
8461 - TCCAGAAAATGTAGTTAGCATGCATGGTATAGCCATCAATTTGTTCCTTCGGCTTGCCAA - 8520
     - S  R  K  C  S  *  H  A  W  Y  S  H  Q  F  V  P  S  A  C  Q
     -  P  E  N  V  V  S  M  H  G  I  A  I  N  L  F  L  R  L  A  K
     -   Q  K  M  *  L  A  C  M  V  *  P  S  I  C  S  F  G  L  P  R
8521 - GATAGTTAGCCCCAATTAAAAATGCTTCCGATGATGATGCATTTACATTTGTAACAAAAG - 8580
     - D  S  *  P  Q  L  K  M  L  P  M  M  M  H  L  H  L  *  Q  K
     -  I  V  S  P  N  *  K  C  F  R  *  *  C  I  Y  I  C  N  K  S
     -   *  L  A  P  I  K  N  A  S  D  D  D  A  F  T  F  V  T  K  A
8581 - CTGTCCACCATGAGAAATGGCCCATAAGCTTGTAAAGGTCAGCATTCCAAGAATGCTCTG - 8640
     - L  S  T  M  R  N  G  P  *  A  C  K  G  Q  H  S  K  N  A  L
     -  C  P  P  *  E  M  A  H  K  L  V  K  V  S  I  P  R  M  L  C
     -   V  H  H  E  K  W  P  I  S  L  *  R  S  A  F  Q  E  C  S  V
8641 - TTATCTTTACAGCTATAGAACCACCCAGGGCTAGTTTTTGCTTTATAAATCCACACAGAT - 8700
     - L  S  L  Q  L  *  N  H  P  G  L  V  F  A  L  *  I  H  T  D
     -  Y  L  Y  S  Y  R  T  T  Q  G  *  F  L  L  Y  K  S  T  Q  I
     -   I  F  T  A  I  E  P  P  R  A  S  F  C  F  I  N  P  H  R  *
8701 - AAGTGAAAAACCCTTCTTTAGAGTCATTCTCTTTTGTCACATGTTTGGTCCTAGGGTCAT - 8760
     - K  *  K  T  L  L  *  S  H  S  L  L  S  H  V  W  S  *  G  H
     -  S  E  K  P  F  F  R  V  I  L  F  C  H  M  F  G  P  R  V  I
     -   V  K  N  P  S  L  E  S  F  S  F  V  T  C  L  V  L  G  S  Y
8761 - ACATATCGCTAATAATAAGGTCCCATTTATTAGCCGTATGTACTGTTGCACAGTCTCCAA - 8820
     - T  Y  R  *  *  *  G  P  I  Y  *  P  Y  V  L  L  H  S  L  Q
     -  H  I  A  N  N  K  V  P  F  I  S  R  M  Y  C  C  T  V  S  N
     -   I  S  L  I  I  R  S  H  L  L  A  V  C  T  V  A  Q  S  P  I
8821 - TTAAAGTAGAATCTGCGTCGGAGACGAAGTCATTAAGATCTGAATCGACAAGTAGTGTGC - 8880
     - L  K  *  N  L  R  R  R  R  S  H  *  D  L  N  R  Q  V  V  C
     -  *  S  R  I  C  V  G  D  E  V  I  K  I  *  I  D  K  *  C  A
     -   K  V  E  S  A  S  E  T  K  S  L  R  S  E  S  T  S  S  V  P
8881 - CAGTTGGCAACCATTGTCTGAGCACAGCTGTACCTGGTGCAACTCCTTTATCAGAGCCAG - 8940
     - Q  L  A  T  I  V  *  A  Q  L  Y  L  V  Q  L  L  Y  Q  S  Q
     -  S  W  Q  P  L  S  E  H  S  C  T  W  C  N  S  F  I  R  A  S
     -   V  G  N  H  C  L  S  T  A  V  P  G  A  T  P  L  S  E  P  A
8941 - CACCAAAGTGAATAACTCTCATGTTGTAGGGTACAGCTAAAGTAAGTGTATTTAAGTATT - 9000
     - H  Q  S  E  *  L  S  C  C  R  V  Q  L  K  *  V  Y  L  S  I
     -  T  K  V  N  N  S  H  V  V  G  Y  S  *  S  K  C  I  *  V  L
     -   P  K  *  I  T  L  M  L  *  G  T  A  K  V  S  V  F  K  Y  *
9001 - GACACAGTTGAGTATACTTTGCGACATTCATCATTATTCCTTTTGGTATAACAGCATTTT - 9060
     - D  T  V  E  Y  T  L  R  H  S  S  L  F  L  L  V  *  Q  H  F
     -  T  Q  L  S  I  L  C  D  I  H  H  Y  S  F  W  Y  N  S  I  F
     -   H  S  *  V  Y  F  A  T  F  I  I  I  P  F  G  I  T  A  F  S
9061 - CACCATAATTCTGAAGGTCACACTTTTCAAGAAGCATTCTTTGCATCTTGTACAAGTTAG - 9120
     - H  H  N  S  E  G  H  T  F  Q  E  A  F  F  A  S  C  T  S  *
     -  T  I  I  L  K  V  T  L  F  K  K  H  S  L  H  L  V  Q  V  R
     -   P  *  F  *  R  S  H  F  S  R  S  I  L  C  I  L  Y  K  L  G
9121 - GCATCGCAACACCTGGTTGCCACGCTTGACTTGCTTGTAGTTTTGGGTAGAAGGTTTCAA - 9180
     - A  S  Q  H  L  V  A  T  L  D  L  L  V  V  L  G  R  R  F  Q
     -  H  R  N  T  W  L  P  R  L  T  C  L  *  F  W  V  E  G  F  N
     -   I  A  T  P  G  C  H  A  *  L  A  C  S  F  G  *  K  V  S  T
9181 - CATGTCCATCCTTACACCAAAGCATGAATGAAATTTCAGCATAGTCAATTGTAACCTTGA - 9240
     - H  V  H  P  Y  T  K  A  *  M  K  F  Q  H  S  Q  L  *  P  *
     -  M  S  I  L  T  P  K  H  E  *  N  F  S  I  V  N  C  N  L  D
     -   C  P  S  L  H  Q  S  M  N  E  I  S  A  *  S  I  V  T  L  T
```

FIG. 12 Con't

```
 9241 - CCACTTTTGAAATCACTGACAAATCTTGTGACTTTATTATCTCGACAAAGTCATCAAGTA - 9300
      -  P  L  L  K  S  L  T  N  L  V  T  L  L  S  R  Q  S  H  Q  V
      -  H  F  *  N  H  *  Q  I  L  *  L  Y  Y  L  D  K  V  I  K  *
      -     T  F  E  I  T  D  K  S  C  D  F  I  I  S  T  K  S  S  S  K
 9301 - AAAGATCAATCACAGAACACACACATTTTGATGAACCTGTTTGCGCATCTGTTATGAAGT - 9360
      -  K  D  Q  S  Q  N  T  H  I  L  M  N  L  F  A  H  L  L  *  S
      -  K  I  N  H  R  T  H  T  F  *  *  T  C  L  R  I  C  Y  E  V
      -     R  S  I  T  E  H  T  H  F  D  E  P  V  C  A  S  V  M  K  *
 9361 - AATTTTTCACTGTGCTGTCCATAGGGATAAAATCCTCTAATTTAAGTGGTGAATCTTGTG - 9420
      -  N  F  S  L  C  C  P  *  G  *  N  P  L  I  *  V  V  N  L  V
      -  I  F  H  C  A  V  H  R  D  K  I  L  *  F  K  W  *  I  L  *
      -     F  F  T  V  L  S  I  G  I  K  S  S  N  L  S  G  E  S  C  E
 9421 - AGCGCTTGGCTAAGCCTATCATTAAATGAAGACCGCCAAGTTGTCCATGACTGAAATCTC - 9480
      -  S  A  W  L  S  L  S  N  E  D  R  Q  V  V  H  D  *  N  L
      -  A  L  G  *  A  Y  H  *  M  K  T  A  K  L  S  M  T  E  I  S
      -     R  L  A  K  P  I  I  K  *  R  P  P  S  C  P  *  L  K  S  P
 9481 - CATAAACGATGTGTTCGAAGGCATAGCCCTCGAGCTTATATCGCTGTATGAATTCATCCA - 9540
      -  H  K  R  C  V  R  R  H  S  P  R  A  Y  I  A  V  *  I  H  P
      -  I  N  D  V  F  E  G  I  A  L  E  L  I  S  L  Y  E  F  I  H
      -     *  T  M  C  S  K  A  *  P  S  S  L  Y  R  C  M  N  S  S  I
 9541 - TAGCGAGCTCGAGAAAGTCAGTTTCCATTTGTGATCTGGGCTTAAAATCCTCTAAGTCTC - 9600
      -  *  R  A  R  E  S  Q  F  P  F  V  I  W  A  *  N  P  L  S  L
      -  S  E  L  E  K  V  S  F  H  L  *  S  G  L  K  I  L  *  V  S
      -     A  S  S  R  K  S  V  S  I  C  D  L  G  L  K  S  S  K  S  L
 9601 - TGCTCTGAGTAAAGTAGGTTTCAGGCAACTGTTGAATAATGCCGTCTACTTTCTTAAAGT - 9660
      -  C  S  E  *  S  R  F  Q  A  T  V  E  *  C  R  L  L  S  *  S
      -  A  L  S  K  V  G  F  R  Q  L  L  N  N  A  V  Y  F  L  K  V
      -     L  *  V  K  *  V  S  G  N  C  *  I  M  P  S  T  F  L  K  *
 9661 - AGTTAAACTGTGTTTTTACTGATTCTCCAATTAATGTGACTCCATTGACGCTAGCTTGTG - 9720
      -  S  *  T  V  F  L  L  I  L  Q  L  M  *  L  H  *  R  *  L  V
      -  V  K  L  C  F  Y  *  F  S  N  *  C  D  S  I  D  A  S  L  C
      -     L  N  C  V  F  T  D  S  P  I  N  V  T  P  L  T  L  A  C  A
 9721 - CTGGTCCCTTTGAAGGTGTTAGACCTTTGACTGAACCTTCTGTTATTAAAACACCATTAC - 9780
      -  L  V  P  L  K  V  L  D  L  *  L  N  L  L  L  L  K  H  H  Y
      -  W  S  L  *  R  C  *  T  F  D  *  T  F  C  Y  *  N  T  I  T
      -     G  P  F  E  G  V  R  P  L  T  E  P  S  V  I  K  T  P  L  R
 9781 - GGGCGTTTCTAAAAAGGTCTACCTGTCCTTCCACTCTACCATCAAACAAGACAGTAAGTG - 9840
      -  G  R  F  *  K  G  L  P  V  L  P  L  Y  H  Q  T  R  Q  *  V
      -  G  V  S  K  K  V  Y  L  S  F  H  S  T  I  K  Q  D  S  K  *
      -     A  F  L  K  R  S  T  C  P  S  T  L  P  S  N  K  T  V  S  E
 9841 - AAGAACAAGCACTCTCAGTAGGTTTCTTGGCAATGTCAGTCATTGTGCAGACACCTATTG - 9900
      -  K  N  K  H  S  Q  *  V  S  W  Q  C  Q  S  L  C  R  H  L  L
      -  R  T  S  T  L  S  R  F  L  G  N  V  S  H  C  A  D  T  Y  C
      -     E  Q  A  L  S  V  G  F  L  A  M  S  V  I  V  Q  T  P  I  V
 9901 - TAGATACATGTGCTGGGGCTTCTCTTTTGTAGTCCCAGATTACAGTATTAGCAGCGATAT - 9960
      -  *  I  H  V  L  G  L  L  F  C  S  P  R  L  Q  Y  *  Q  R  Y
      -  R  Y  M  C  W  G  F  S  F  V  V  P  D  Y  S  I  S  S  D  I
      -     D  T  C  A  G  A  S  L  L  *  S  Q  I  T  V  L  A  A  I  S
 9961 - CAACACCCAAATTATTGAGTATCTTAATCTCTGGCACTGGTTTAATGTTACGCTTAGCCC - 10020
      -  Q  H  P  N  Y  *  V  S  *  S  L  A  L  V  *  C  Y  A  *  P
      -  N  T  Q  I  I  E  Y  L  N  L  W  H  W  F  N  V  T  L  S  P
      -     T  P  K  L  L  S  I  L  I  S  G  T  G  L  M  L  R  L  A  Q
10021 - AAAGCTCAAATGCAACATTAACAGGAAGTGTTGTCTTATTTTCAAAGATCTCCACATCAA - 10080
      -  K  A  Q  M  Q  H  *  Q  E  V  L  S  Y  F  Q  R  S  P  H  Q
      -  K  L  K  C  N  I  N  R  K  C  C  L  I  F  K  D  L  H  I  N
      -     S  S  N  A  T  L  T  G  S  V  V  L  F  S  K  I  S  T  S  I
```

FIG. 12 Con't

```
10081 - TACCATCTACCTTTGTGTAAACAGCATTATTAATGATGGAAACAGGTGCTTCGCCGGCGT - 10140
      - Y  H  L  P  L  C  K  Q  H  Y  *  *  W  K  Q  V  L  R  R  R
      -  T  I  Y  L  C  V  N  S  I  I  N  D  G  N  R  C  F  A  G  V
      -   P  S  T  F  V  *  T  A  L  L  M  M  E  T  G  A  S  P  A  C
10141 - GTCCATCAAAGTGTCCTTTATTAACAACATTATAAGCCACATTTTCTAAACTCTGTAACC - 10200
      - V  H  Q  S  V  L  Y  *  Q  H  Y  K  P  H  F  L  N  S  V  T
      -  S  I  K  V  S  F  I  N  N  I  I  S  H  I  F  *  T  L  *  P
      -   P  S  K  C  P  L  L  T  T  L  *  A  T  F  S  K  L  C  N  L
10201 - TGGTAAATGTATTCCACAGGTTATAAGTATCAAATTGTTTGTAAATCCATAGGCTAAATC - 10260
      - W  *  M  Y  S  T  G  Y  K  Y  Q  I  V  C  K  S  I  G  *  I
      -  G  K  C  I  P  Q  V  I  S  I  K  L  F  V  N  P  *  A  K  S
      -   V  N  V  F  H  R  L  *  V  S  N  C  L  *  I  H  R  L  N  P
10261 - CAGCAGAAATCATCATATTATATGCATCCAAGTACTGTCGGTACTCATTTGCATGGTGTC - 10320
      - Q  Q  K  S  S  Y  Y  M  H  P  S  T  V  G  T  H  L  H  G  V
      -  S  R  N  H  H  I  I  C  I  Q  V  L  S  V  L  I  C  M  V  S
      -   A  E  I  I  I  L  Y  A  S  K  Y  C  R  Y  S  F  A  W  C  L
10321 - TGCAAACAGCACCACCTAAATTGCATCGTGTAATACACGTAGCAGATTTGAGTGGAACAT - 10380
      - C  K  Q  H  H  L  N  C  I  V  *  Y  T  *  Q  I  *  V  E  H
      -  A  N  S  T  T  *  I  A  S  C  N  T  R  S  R  F  E  W  N  I
      -   Q  T  A  P  P  K  L  H  R  V  I  H  V  A  D  L  S  G  T  *
10381 - AATCAATATCCGACACTACTTGTTTGCCATGAGACTCACAAGGACTATCAGAATAGTAAA - 10440
      - N  Q  Y  P  T  L  L  V  C  H  E  T  H  K  D  Y  Q  N  S  K
      -  I  N  I  R  H  Y  L  F  A  M  R  L  T  R  T  I  R  I  V  K
      -   S  I  S  D  T  T  C  L  P  *  D  S  Q  G  L  S  E  *  *  K
10441 - AGAAAGGCAATTGCTTTAAATTAGTAAATGCACTTTTATCGAAAGCTGGAGTGTGGAATG - 10500
      - R  K  A  I  A  L  N  *  *  M  H  F  Y  R  K  L  E  C  G  M
      -  E  R  Q  L  L  *  I  S  K  C  T  F  I  E  S  W  S  V  E  C
      -   K  G  N  C  F  K  L  V  N  A  L  L  S  K  A  G  V  W  N  A
10501 - CATGCTTATTCACATACAAACTACCACCATCACAGCCTGGTAAGTTCAAGTTTGACAAGA - 10560
      - H  A  Y  S  H  T  N  Y  H  H  H  S  L  V  S  S  S  L  T  R
      -  M  L  I  H  I  Q  T  T  T  I  T  A  W  *  V  Q  V  *  Q  D
      -   C  L  F  T  Y  K  L  P  P  S  Q  P  G  K  F  K  F  D  K  T
10561 - CTCTTGTGTCAAACCTACACACAATTGCATTGGCTGGGTAACGATCAACGTTACAATTCC - 10620
      - L  L  C  Q  T  Y  T  Q  L  H  W  L  G  N  D  Q  R  Y  N  S
      -  S  C  V  K  P  T  H  N  C  I  G  W  V  T  I  N  V  T  I  P
      -   L  V  S  N  L  H  T  I  A  L  A  G  *  R  S  T  L  Q  F  Q
10621 - AAAACAAACAAACACCATCAGTGAATTTATCGTGATGTGTAGCATAAGAATAGAAGAGTT - 10680
      - K  T  N  K  H  H  Q  *  I  Y  R  D  V  *  H  K  N  R  R  V
      -  K  Q  T  N  T  I  S  E  F  I  V  M  C  S  I  R  I  E  E  F
      -   N  K  Q  T  P  S  V  N  L  S  *  C  V  A  *  E  *  K  S  S
10681 - CCTCTATTTTGTAAGCTTTGTCACTACATGGCTGAGCATCGTAGAACTTCCATTCTACTT - 10740
      - P  L  F  C  K  L  C  H  Y  M  A  E  H  R  R  T  S  I  L  L
      -  L  Y  F  V  S  F  V  T  T  W  L  S  I  V  E  L  P  F  Y  F
      -   S  I  L  *  A  L  S  L  H  G  *  A  S  *  N  F  H  S  T  S
10741 - CAGCCTGAGGCACACACTTGATAGCCTTTGGATTTCCAATGTCATGAAGAACTGGAAACT - 10800
      - Q  P  E  A  H  T  *  *  P  L  D  F  Q  C  H  E  E  L  E  T
      -  S  L  R  H  T  L  D  S  L  W  I  S  N  V  M  K  N  W  K  L
      -   A  *  G  T  H  L  I  A  F  G  F  P  M  S  *  R  T  G  N  L
10801 - TATCAGCAAGCAATGCAGACTTCACAACCATGTGTTGTACTTTTCTGCAAGCAGAATTAA - 10860
      - Y  Q  Q  A  M  Q  T  S  Q  P  C  V  V  L  F  C  K  Q  N  *
      -  I  S  K  Q  C  R  L  H  N  H  V  L  Y  F  S  A  S  R  I  N
      -   S  A  S  N  A  D  F  T  T  M  C  C  T  F  L  Q  A  E  L  T
10861 - CCCTCAGTTCATCTCCTATAATAGGGTATTCAACAGACCAATCAACGCGCTTAACAAAGC - 10920
      - P  S  V  H  L  L  *  *  G  I  Q  Q  T  N  Q  R  A  *  Q  S
      -  P  Q  F  I  S  Y  N  R  V  F  N  R  P  I  N  A  L  N  K  A
      -   L  S  S  S  P  I  I  G  Y  S  T  D  Q  S  T  R  L  T  K  H
```

FIG. 12 Con't

```
10921 - ACTCATGGACTGCTAAACATCTAGTCATGATAGCATCACAACTAGCCACATGTGCATTTC - 10980
     -   T  H  G  L  L  N  I  *  S  *  *  H  H  N  *  P  H  V  H  F
     - L  M  D  C  *  T  S  S  H  D  S  I  T  T  S  H  M  C  I  S
     -  S  W  T  A  K  H  L  V  M  I  A  S  Q  L  A  T  C  A  F  P
10981 - CATGTACCTGGCAATGTTGGTCATGGTTACTCTGAAGGTTACCCGTAAAGCCCCACTGCT - 11040
     -   H  V  P  G  N  V  G  H  G  Y  S  E  G  Y  P  *  S  P  T  A
     - M  Y  L  A  M  L  V  M  V  T  L  K  V  T  R  K  A  P  L  L
     -  C  T  W  Q  C  W  S  W  L  L  *  R  L  P  V  K  P  H  C  *
11041 - GAACATCAATCATAAATGGGTTATAGACATAGTCAAAACCCACAGAATGATTCCAGCAGG - 11100
     - E  H  Q  S  *  M  G  Y  R  H  S  Q  N  P  Q  N  D  S  S  R
     -  N  I  N  H  K  W  V  I  D  I  V  K  T  H  R  M  I  P  A  G
     -   T  S  I  I  N  G  L  *  T  *  S  K  P  T  E  *  F  Q  Q  A
11101 - CATAAGTATCTGATGAAGTAGAAAAGCAAGTTGCACGTTTGTCACACAGACAACACGTTC - 11160
     - H  K  Y  L  M  K  *  K  S  K  L  H  V  C  H  T  D  N  T  F
     -  I  S  I  *  *  S  R  K  A  S  C  T  F  V  T  Q  T  T  R  S
     -   *  V  S  D  E  V  E  K  Q  V  A  R  L  S  H  R  Q  H  V  L
11161 - TTTCAGGTCCAATCTTGACAAAGTACTTCATTGATGTAAGCTCAAAGCCATGCGCCCAAA - 11220
     - F  Q  V  Q  S  *  Q  S  T  S  L  M  *  A  Q  S  H  A  P  K
     -  F  R  S  N  L  D  K  V  L  H  *  C  K  L  K  A  M  R  P  K
     -   S  G  P  I  L  T  K  Y  F  I  D  V  S  S  K  P  C  A  Q  R
11221 - GGACGAACACGACTCTGTCTGACAATCCTTTCAGTGTATCACTGAGCATTTGTACTATCT - 11280
     - G  R  T  R  L  C  L  T  I  L  S  V  Y  H  *  A  F  V  L  S
     -  D  E  H  D  S  V  *  Q  S  F  Q  C  I  T  E  H  L  Y  Y  L
     -   T  N  T  T  L  S  D  N  P  F  S  V  S  L  S  I  C  T  I  L
11281 - TAATACGCACTACATTCCAGGGCAAGCCTTTATACATGAGTGGTATAAGATGTTTAAACT - 11340
     - *  Y  A  L  H  S  R  A  S  L  Y  T  *  V  V  *  D  V  *  T
     -  N  T  H  Y  I  P  G  Q  A  F  I  H  E  W  Y  K  M  F  K  L
     -   I  R  T  T  F  Q  G  K  P  L  Y  M  S  G  I  R  C  L  N  W
11341 - GGTCACCTGGTGGAGGTTTTGCATTAACTCTGGTGAATTCTGTGTTATTTTCAGTGTCAA - 11400
     - G  H  L  V  E  V  L  H  *  L  W  *  I  L  C  Y  F  Q  C  Q
     -  V  T  W  W  R  F  C  I  N  S  G  E  F  C  V  I  F  S  V  N
     -   S  P  G  G  G  F  A  L  T  L  V  N  S  V  L  F  S  V  S  T
11401 - CATAACCAGTCGGTACAGCTACTAAGTTAACACCTGTAGAAAATCCTAGCTGGAGAGGTA - 11460
     - H  N  Q  S  V  Q  L  L  S  *  H  L  *  K  I  L  A  G  E  V
     -  I  T  S  R  Y  S  Y  *  V  N  T  C  R  K  S  *  L  E  R  *
     -   *  P  V  G  T  A  T  K  L  T  P  V  E  N  P  S  W  R  G  R
11461 - GGTTAGTACCCACAGCATCTCTAGTTGCATGACAGCCCTCTACATCAAAGCCAATCCACG - 11520
     - G  *  Y  P  Q  H  L  *  L  H  D  S  P  L  H  Q  S  Q  S  T
     -  V  S  T  H  S  I  S  S  C  M  T  A  L  Y  I  K  A  N  P  R
     -   L  V  P  T  A  S  L  V  A  *  Q  P  S  T  S  K  P  I  H  A
11521 - CACGAACGTGACGAATAGCTTCTTCGCGGGTGATAAACATATTAGGGTAACCATTGACTT - 11580
     - H  E  R  D  *  L  L  R  G  *  *  T  Y  *  G  N  H  *  L
     -  T  N  V  T  N  S  F  F  A  G  D  K  H  I  R  V  T  I  D  L
     -   R  T  *  R  I  A  S  S  R  V  I  N  I  L  G  *  P  L  T  W
11581 - GGTAATTCATTTGAAACCCATCATAGAGATGAGTCTACGGTAGGTCATGTCCTTTGGTA - 11640
     - G  N  S  F  *  N  P  S  *  R  *  V  Y  G  R  S  C  P  L  V
     -  V  I  H  F  E  T  H  H  R  D  E  S  T  V  G  H  V  L  W  Y
     -   *  F  I  L  K  P  I  I  E  M  S  L  R  *  V  M  S  F  G  M
11641 - TGCCTGGTATGTCAACACATAATCCTTCAGTCTTGAATTTTATATCAACGCTGAGGTGTG - 11700
     - C  L  V  C  Q  H  I  I  L  Q  S  *  I  L  Y  Q  R  *  G  V
     -  A  W  Y  V  N  T  *  S  F  S  L  E  F  Y  I  N  A  E  V  C
     -   P  G  M  S  T  H  N  P  S  V  L  N  F  I  S  T  L  R  C  V
11701 - TAGGTGCCTGTGTAGGATGAAGACCAGTAATGATCTTACTACAGTCCTTAAAAAGTCCAG - 11760
     - *  V  P  V  *  D  E  D  Q  *  *  S  Y  Y  S  P  *  K  V  Q
     -  R  C  L  C  R  M  K  T  S  N  D  L  T  T  V  L  K  K  S  S
     -   G  A  C  V  G  *  R  P  V  M  I  L  L  Q  S  L  K  S  P  V
```

FIG. 12 Con't

```
11761 - TTACATTTTCTGCTTGTAATGTAGCCACATTGCGACGTGGTATTTCTAGACTTGTAAATT - 11820
       - L  H  F  L  L  V  M  *  P  H  C  D  V  V  F  L  D  L  *  I
       -  Y  I  F  C  L  *  C  S  H  I  A  T  W  Y  F  *  T  C  K  L
       -   T  F  S  A  C  N  V  A  T  L  R  R  G  I  S  R  L  V  N  C
11821 - GCAGTTTGTCATAAAGATCTCTATCAGACATTATGCACAAAATGCCAATTTTTGCCCTTG - 11880
       - A  V  C  H  K  D  L  Y  Q  T  L  C  T  K  C  Q  F  L  P  L
       -  Q  F  V  I  K  I  S  I  R  H  Y  A  Q  N  A  N  F  C  P  C
       -   S  L  S  *  R  S  L  S  D  I  M  H  K  M  P  I  F  A  L  V
11881 - TGATAGCCACATTGAAGCGGTTGACATTACAAGAGTGTGCTGTTTCAGTAGTTTGTGTGA - 11940
       - *  *  P  H  *  S  G  *  H  Y  K  S  V  L  F  Q  *  F  V  *
       -  D  S  H  I  E  A  V  D  I  T  R  V  C  C  F  S  S  L  C  E
       -   I  A  T  L  K  R  L  T  L  Q  E  C  A  V  S  V  V  C  V  N
11941 - ATATGACATAGTCATATTCAGAACCCTGTGATGAATCAACAGTCTGCGTAGGCAATCCTA - 12000
       - I  *  H  S  H  I  Q  N  P  V  M  N  Q  Q  S  A  *  A  I  L
       -  Y  D  I  V  I  F  R  T  L  *  *  I  N  S  L  R  R  Q  S  *
       -   M  T  *  S  Y  S  E  P  C  D  E  S  T  V  C  V  G  N  P  K
12001 - AGATTTTTGAAGCTACAGCGTTCTGTGAATTATAAGGTGAGATAAAAACAGCTTTTCTCC - 12060
       - R  F  L  K  L  Q  R  S  V  N  Y  K  V  R  *  K  Q  L  F  S
       -  D  F  *  S  Y  S  V  L  *  I  I  R  *  D  K  N  S  F  S  P
       -   I  F  E  A  T  A  F  C  E  L  *  G  E  I  K  T  A  F  L  Q
12061 - AAGCAGGATTGCGTGTAAGAAATTCTCTTACAACGCCTATTTGAGGTCTGTTGATTGCAG - 12120
       - K  Q  D  C  V  *  E  I  L  L  Q  R  L  F  E  V  C  *  L  Q
       -  S  R  I  A  C  K  K  F  S  Y  N  A  Y  L  R  S  V  D  C  R
       -   A  G  L  R  V  R  N  S  L  T  T  P  I  *  G  L  L  I  A  D
12121 - ATGAAACATCATGTGTAATAACACCTTTGTAGAACATTTTGAAGCATTGAGCTGACTTAT - 12180
       - M  K  H  H  V  *  *  H  L  C  R  T  F  *  S  I  E  L  T  Y
       -  *  N  I  M  C  N  N  T  F  V  E  H  F  E  A  L  S  *  L  I
       -   E  T  S  C  V  I  T  P  L  *  N  I  L  K  H  *  A  D  L  S
12181 - CCTTGTGTGCTTTTAGCTTATTGTCATAAACTAAAGCACTCACAGTGTCAACAATTTCAG - 12240
       - P  C  V  L  L  A  Y  C  H  K  L  K  H  S  Q  C  Q  Q  F  Q
       -  L  V  C  F  *  L  I  V  I  N  *  S  T  H  S  V  N  N  F  S
       -   L  C  A  F  S  L  L  S  *  T  K  A  L  T  V  S  T  I  S  A
12241 - CAGGACAACGGCGACAAGTTCCAAGGAACATGTCTGGACCTATTGTTTTCATAAGTCTGC - 12300
       - Q  D  N  G  D  K  F  Q  G  T  C  L  D  L  L  F  S  *  V  C
       -  R  T  T  A  T  S  S  K  E  H  V  W  T  Y  C  F  H  K  S  A
       -   G  Q  R  R  Q  V  P  R  N  M  S  G  P  I  V  F  I  S  L  H
12301 - ACACTGAATTAAAATATTCTGGTTCTAGTGTGCCTTTAGTCAGCAATGTGCGGGGGGCTG - 12360
       - T  L  N  *  N  I  L  V  L  V  C  L  *  S  A  M  C  G  G  L
       -  H  *  I  K  I  F  W  F  *  C  A  F  S  Q  Q  C  A  G  G  W
       -   T  E  L  K  Y  S  G  S  S  V  P  L  V  S  N  V  R  G  A  G
12361 - GTAATTGAGCAGGATCGCCAATATAGACGTAGTGTTTTGCACGAAGTCTAGCATTGACAA - 12420
       - V  I  E  Q  D  R  Q  Y  R  R  S  V  L  H  E  V  *  H  *  Q
       -  *  L  S  R  I  A  N  I  D  V  V  F  C  T  K  S  S  I  D  N
       -   N  *  A  G  S  P  I  *  T  *  C  F  A  R  S  L  A  L  T  T
12421 - CACTCAAGTCATAATTAGTAGCCATAGAGATTTCATCAAAGACTACAATGTCAGCAGTTG - 12480
       - H  S  S  H  N  *  *  P  *  R  F  H  Q  R  L  Q  C  Q  Q  L
       -  T  Q  V  I  I  S  S  H  R  D  F  I  K  D  Y  N  V  S  S  C
       -   L  K  S  *  L  V  A  I  E  I  S  S  K  T  T  M  S  A  V  V
12481 - TTTCTGGCAATGCATTTACAGTGCAGAAAACATACTGTTCTAGTGTTGAATTCACTTTGA - 12540
       - F  L  A  M  H  L  Q  C  R  K  H  T  V  L  V  L  N  S  L  *
       -  F  W  Q  C  I  Y  S  A  E  N  I  L  F  *  C  *  I  H  F  E
       -   S  G  N  A  F  T  V  Q  K  T  Y  C  S  S  V  E  F  T  L  N
12541 - ATTTATCAAAACACTCTACGCGCGCACGCGCAGGTATGATTCTACTACATTTATCTATGG - 12600
       - I  Y  Q  N  T  L  R  A  H  A  Q  V  *  F  Y  Y  I  Y  L  W
       -  F  I  K  T  L  Y  A  R  T  R  R  Y  D  S  T  T  F  I  Y  G
       -   L  S  K  H  S  T  R  A  R  A  G  M  I  L  L  H  L  S  M  G
```

FIG. 12 Con't

```
12601 - GCAAATATTTTAATGCCTTTTCACATAGGGCATCAACAGCTGCATGAGAGCATGCCGTAT - 12660
      - A  N  I  L  M  P  F  H  I  G  H  Q  Q  L  H  E  S  M  P  Y
      -  Q  I  F  *  C  L  F  T  *  G  I  N  S  C  M  R  A  C  R  I
      -   K  Y  F  N  A  F  S  H  R  A  S  T  A  A  *  E  H  A  V  Y
12661 - ACACTATGCGAGCAGATGGGTAATAGAGAGCAAGTCCGATGGCAAAATGACTCTTACCAG - 12720
      - T  L  C  E  Q  M  G  N  R  E  Q  V  R  W  Q  N  D  S  Y  Q
      -  H  Y  A  S  R  W  V  I  E  S  K  S  D  G  K  M  T  L  T  S
      -   T  M  R  A  D  G  *  *  R  A  S  P  M  A  K  *  L  L  P  V
12721 - TACCAGGTGGTCCTTGGAGTGTAGAGTACTTTTGCATGCCGACCTTTTGATAATTTGCAA - 12780
      - Y  Q  V  V  L  G  V  *  S  T  F  A  C  R  P  F  D  N  L  Q
      -  T  R  W  S  L  E  C  R  V  L  L  H  A  D  L  L  I  I  C  N
      -   P  G  G  P  W  S  V  E  Y  F  C  M  P  T  F  *  *  F  A  T
12781 - CATTGCTAGAAAACTCATCTGAGATGTTGAGTGTTGGGTACAAGCCAGTAATTCTCACAT - 12840
      - H  C  *  K  T  H  L  R  C  *  V  L  G  T  S  Q  *  F  S  H
      -  I  A  R  K  L  I  *  D  V  E  C  W  V  Q  A  S  N  S  H  I
      -   L  L  E  N  S  S  E  M  L  S  V  G  Y  K  P  V  I  L  T  *
12841 - AGTGCTCTTGTGGCACTAGAGTAGGTGCACTAAGTGGCATTACAGTGTGAGATGTCAACA - 12900
      - S  A  L  V  A  L  E  *  V  H  *  V  A  L  Q  C  E  M  S  T
      -  V  L  L  W  H  *  S  R  C  T  K  W  H  Y  S  V  R  C  Q  H
      -   C  S  C  G  T  R  V  G  A  L  S  G  I  T  V  *  D  V  N  T
12901 - CAAAGTAATCACCAACATTCAACTTGTATGTCGTAGTACCTCTGTACACAACAGCATCAC - 12960
      - Q  S  N  H  Q  H  S  T  C  M  S  *  Y  L  C  T  Q  Q  H  H
      -  K  V  I  T  N  I  Q  L  V  C  R  S  T  S  V  H  N  S  I  T
      -   K  *  S  P  T  F  N  L  Y  V  V  V  P  L  Y  T  T  A  S  P
12961 - CATAGTCACCTTTTTCAAAGGTGTACTCTCCAATCTGTACTTTACTATTTTTAGTTACAC - 13020
      - H  S  H  L  F  Q  R  C  T  L  Q  S  V  L  Y  Y  F  *  L  H
      -  I  V  T  F  F  K  G  V  L  S  N  L  Y  F  T  I  F  S  Y  T
      -   *  S  P  F  S  K  V  Y  S  P  I  C  T  L  L  F  L  V  T  R
13021 - GGTAACCAGTAAAGACATAGTTTCTGTTCAATGGTGGTCTAGGTTTTCCAACCTCCCATG - 13080
      - G  N  Q  *  R  H  S  F  C  S  M  V  V  *  V  F  Q  P  P  M
      -  V  T  S  K  D  I  V  S  V  Q  W  W  S  R  F  S  N  L  P  *
      -   *  P  V  K  T  *  F  L  F  N  G  G  L  G  F  P  T  S  H  E
13081 - AAAGATGCAATTCTCTGTCAGAGAGTACTTCGCGTACAGTGGCAATACCATATGACAGCT - 13140
      - K  D  A  I  L  C  Q  R  V  L  R  V  Q  W  Q  Y  H  M  T  A
      -  K  M  Q  F  S  V  R  E  Y  F  A  Y  S  G  N  T  I  *  Q  L
      -   R  C  N  S  L  S  E  S  T  S  R  T  V  A  I  P  Y  D  S  L
13141 - TAAATGTTTCCTCAGTGGCTTTGAGCGTTTCTGCTGCGAAAAGCTTGAGTCTCTCAGTAC - 13200
      - *  M  F  P  Q  W  L  *  A  F  L  L  R  K  A  *  V  S  Q  Y
      -  K  C  F  L  S  G  F  E  R  F  C  C  E  K  L  E  S  L  S  T
      -   N  V  S  S  V  A  L  S  V  S  A  A  K  S  L  S  L  S  V  Q
13201 - AAGTGTTGGCAAGTATGTAATCGCCAGCATTAGTCCAATCACATGTTGCTATCGCATTGA - 13260
      - K  C  W  Q  V  C  N  R  Q  H  *  S  N  H  M  L  L  S  H  *
      -  S  V  G  K  Y  V  I  A  S  I  S  P  I  T  C  C  Y  R  I  E
      -   V  L  A  S  M  *  S  P  A  L  V  Q  S  H  V  A  I  A  L  K
13261 - AGTCAGTGACATTGTCACTGCCTACACATGTGTTTTGTATAAACCAAAAACCTGACCAT - 13320
      - S  Q  *  H  C  H  C  L  H  M  C  F  C  I  N  Q  K  P  D  H
      -  V  S  D  I  V  T  A  Y  T  C  V  F  V  *  T  K  N  L  T  I
      -   S  V  T  L  S  L  P  T  H  V  F  L  Y  K  P  K  T  *  P  L
13321 - TAGCACATAATGGAAAACTAATGGGAGGCTTATGTGACTTGCAATAATAGCTCATACCTC - 13380
      - *  H  I  M  E  N  *  W  E  A  Y  V  T  C  N  N  S  S  Y  L
      -  S  T  *  W  K  T  N  G  R  L  M  *  L  A  I  I  A  H  T  S
      -   A  H  N  G  K  L  M  G  G  L  C  D  L  Q  *  *  L  I  P  P
13381 - CTAGATACAGTTGTGTCACATCAGTGACATCACAACCTGGGGCATTGCAAACATAGGGAT - 13440
      - L  D  T  V  V  S  H  Q  *  H  H  N  L  G  H  C  K  H  R  D
      -  *  I  Q  L  C  H  I  S  D  I  T  T  W  G  I  A  N  I  G  I
      -   R  Y  S  C  V  T  S  V  T  S  Q  P  G  A  L  Q  T  *  G  L
```

FIG. 12 Con't

```
13441 - TAACAGACAACACTAATTTGTGTGATGTTGAAATGACATGGTCATAGCAGCACTTGCAAC - 13500
      - *  Q  T  T  L  I  C  V  M  L  K  *  H  G  H  S  S  T  C  N
      -  N  R  Q  H  *  F  V  *  C  *  N  D  M  V  I  A  A  L  A  T
      -   T  D  N  T  N  L  C  D  V  E  M  T  W  S  *  Q  H  L  Q  H
13501 - ATAGGAATGGTCTCCTAATACAGGCACCGCAACGAAGTGAAGTCTGTGAATTGCACAATA - 13560
      -  I  G  M  V  S  *  Y  R  H  R  N  E  V  K  S  V  N  C  T  I
      - *  E  W  S  P  N  T  G  T  A  T  K  *  S  L  *  I  A  Q  Y
      -   R  N  G  L  L  I  Q  A  P  Q  R  S  E  V  C  E  L  H  N  T
13561 - CACAAGCACCTACAGCCTGCAAGACTGTATGTGGTGTGTACATAGCCTCATAAAACTCAG - 13620
      -  H  K  H  L  Q  P  A  R  L  Y  V  V  C  T  *  P  H  K  T  Q
      -  T  S  T  Y  S  L  Q  D  C  M  W  C  V  H  S  L  I  K  L  R
      -   Q  A  P  T  A  C  K  T  V  C  G  V  Y  I  A  S  *  N  S  G
13621 - GTTCCCAGTACCGTGAGGTGTTATCATTAGTTAGCATTACGGAATACATGTCCAACATGT - 13680
      -  V  P  S  T  V  R  C  Y  H  *  L  A  L  R  N  T  C  P  T  C
      -  F  P  V  P  *  G  V  I  I  S  *  H  Y  G  I  H  V  Q  H  V
      -   S  Q  Y  R  E  V  L  S  L  V  S  I  T  E  Y  M  S  N  M  W
13681 - GGCCAGTAAGCTCATCATGTAACTTTCTAATGTATTGTAAATACAAGTGAAAGACATCAG - 13740
      -  G  Q  *  A  H  H  V  T  F  *  C  I  V  N  T  S  E  R  H  Q
      -  A  S  K  L  I  M  *  L  S  N  V  L  *  I  Q  V  K  D  I  S
      -   P  V  S  S  S  C  N  F  L  M  Y  C  K  Y  K  *  K  T  S  A
13741 - CATACTCCTGATTAGGATGTTTTGTAAGTGGGTAAGCATCAATAGCCAGTGACACGAACC - 13800
      -  H  T  P  D  *  D  V  L  *  V  G  K  H  Q  *  P  V  T  R  T
      -  I  L  L  I  R  M  F  C  K  W  V  S  I  N  S  Q  *  H  E  P
      -   Y  S  *  L  G  C  F  V  S  G  *  A  S  I  A  S  D  T  N  L
13801 - TTTCAATCATAAGTGTACCATCTGTTTTGACAATATCATCGACAAAACAGCCTGCGCCTA - 13860
      -  F  Q  S  *  V  Y  H  L  F  *  Q  Y  H  R  Q  N  S  L  R  L
      -  F  N  H  K  C  T  I  C  F  D  N  I  I  D  K  T  A  C  A  *
      -   S  I  I  S  V  P  S  V  L  T  I  S  S  T  K  Q  P  A  P  N
13861 - ATATTCTTGATGGATCTGGGTAAGGCAGGTACACGTAATCATCTCCTTGTTTAACTAGCA - 13920
      -  I  F  L  M  D  L  G  K  A  G  T  R  N  H  L  L  V  *  L  A
      -  Y  S  *  W  I  W  V  R  Q  V  H  V  I  I  S  L  F  N  *  H
      -   I  L  D  G  S  G  *  G  R  Y  T  *  S  S  P  C  L  T  S  I
13921 - TTGTATGCTGTGAGCAAAATTCGTGAGGTCCTTTAGTAAGGTCAGTCTCAGTCCAACATT - 13980
      -  L  Y  A  V  S  K  I  R  E  V  L  *  *  G  Q  S  Q  S  N  I
      -  C  M  L  *  A  K  F  V  R  S  F  S  K  V  S  L  S  P  T  F
      -   V  C  C  E  Q  N  S  *  G  P  L  V  R  S  V  S  V  Q  H  F
13981 - TTGCCTCAGACATGAACACATTATTTTGATAATAAAGAACTGCCTTAAAGTTCTTAATGC - 14040
      -  L  P  Q  T  *  T  H  Y  F  D  N  K  E  L  P  *  S  S  *  C
      -  C  L  R  H  E  H  I  I  L  I  I  K  N  C  L  K  V  L  N  A
      -   A  S  D  M  N  T  L  F  *  *  *  R  T  A  L  K  F  L  M  L
14041 - TAGCTACTAAACCTTGAGCCGCATAGTTACTGTTATAGCACACAACGGCATCATCAGAAA - 14100
      - *  L  L  N  L  E  P  H  S  Y  C  Y  S  T  Q  R  H  H  Q  K
      -  S  Y  *  T  L  S  R  I  V  T  V  I  A  H  N  G  I  I  R  K
      -   A  T  K  P  *  A  A  *  L  L  L  *  H  T  T  A  S  S  E  R
14101 - GAATCATCATGGAGAAATGTTTACGCAGGTAAGCGTAAAACTCATCCACGAATTCATGAT - 14160
      -  E  S  S  W  R  N  V  Y  A  G  K  R  K  T  H  P  R  I  H  D
      -  N  H  H  G  E  M  F  T  Q  V  S  V  K  L  I  H  E  F  M  I
      -   I  I  M  E  K  C  L  R  R  *  A  *  N  S  S  T  N  S  *  S
14161 - CAACATCCCTATTTCTATAGAGACACTCATAGAGCCTGTGTTGTAGATTGCGGACATACT - 14220
      -  Q  H  P  Y  F  Y  R  D  T  H  R  A  C  V  V  D  C  G  H  T
      -  N  I  P  I  S  I  E  T  L  I  E  P  V  L  *  I  A  D  I  L
      -   T  S  L  F  L  *  R  H  S  *  S  L  C  C  R  L  R  T  Y  L
14221 - TGTCAGCTATCTTATTACCATCAGTTGAAAGAAGTGCATTTACATTGGCTGTAACAGCTT - 14280
      -  C  Q  L  S  Y  Y  H  Q  L  K  E  V  H  L  H  W  L  *  Q  L
      -  V  S  Y  L  I  T  I  S  *  K  K  C  I  Y  I  G  C  N  S  L
      -   S  A  I  L  L  P  S  V  E  R  S  A  F  T  L  A  V  T  A  *
```

FIG. 12 Con't

```
14281 - GACAAATGTTAAAGACACTATTAGCATAAGCAGTTGTAGCATCACCGGATGATGTTCCAC - 14340
      - D  K  C  *  R  H  Y  *  H  K  Q  L  *  H  H  R  M  M  F  H
      -  T  N  V  K  D  T  I  S  I  S  S  C  S  I  T  G  *  C  S  T
      -   Q  M  L  K  T  L  L  A  *  A  V  V  A  S  P  D  D  V  P  P
14341 - CTGGTTTAACATATAGTGAGCCGCCACACATGACCATCTCACTTAATACTTGCGCACACT - 14400
      - L  V  *  H  I  V  S  R  H  T  *  P  S  H  L  I  L  A  H  T
      -  W  F  N  I  *  *  A  A  T  H  D  H  L  T  *  Y  L  R  T  L
      -   G  L  T  Y  S  E  P  P  H  M  T  I  S  L  N  T  C  A  H  S
14401 - CGTTAGCTAACCTGTAGAAACGGTGTGATAAGTTACAGCAAGTGTTATGTTTGCGAGCAA - 14460
      - R  *  L  T  C  R  N  G  V  I  S  Y  S  K  C  Y  V  C  E  Q
      -  V  S  *  P  V  E  T  V  *  *  V  T  A  S  V  M  F  A  S  K
      -   L  A  N  L  *  K  R  C  D  K  L  Q  Q  V  L  C  L  R  A  R
14461 - GAACAAGAGAGGCCATTATCCTAAGCATGTTAGGCATGGCTCTGTCACATTTGGATAAT - 14520
      - E  Q  E  R  P  L  S  *  A  C  *  A  W  L  C  H  I  L  D  N
      -  N  K  R  G  H  Y  P  K  H  V  R  H  G  S  V  T  F  W  I  I
      -   T  R  E  A  I  I  L  S  M  L  G  M  A  L  S  H  F  G  *  S
14521 - CCCAACCCATAAGGTGTGGAGTTTCTACATCACTGTAAACAGTTTTTAACATATTATGCC - 14580
      - P  N  P  *  G  V  E  F  L  H  H  C  K  Q  F  L  T  Y  Y  A
      -  P  T  H  K  V  W  S  F  Y  I  T  V  N  S  F  *  H  I  M  P
      -   Q  P  I  R  C  G  V  S  T  S  L  *  T  V  F  N  I  L  C  Q
14581 - AGCCACCGTAAAACTTGCTTGTTCCAATTACCACAGTAGCTCCTCTAGTGGCGGCTATTG - 14640
      - S  H  R  K  T  C  L  F  Q  L  P  Q  *  L  L  *  W  R  L  L
      -  A  T  V  K  L  A  C  S  N  Y  H  S  S  S  S  S  G  G  Y  *
      -   P  P  *  N  L  L  V  P  I  T  T  V  A  P  L  V  A  A  I  D
14641 - ACTTCAATAATTTCTGATGAAACTGTCTATTTGTCATAGTACTACAGATAGAGACACCAG - 14700
      - T  S  I  I  S  D  E  T  V  Y  L  S  *  Y  Y  R  *  R  H  Q
      -  L  Q  *  F  L  M  K  L  S  I  C  H  S  T  T  D  R  D  T  S
      -   F  N  N  F  *  *  N  C  L  F  V  I  V  L  Q  I  E  T  P  A
14701 - CTACGGTGCGAGCTCTATTCTTTGCACTAATGGCATACTTAAGATTCATTTGAGTTATAG - 14760
      - L  R  C  E  L  Y  S  L  H  *  W  H  T  *  D  S  F  E  L  *
      -  Y  G  A  S  S  I  L  C  T  N  G  I  L  K  I  H  L  S  Y  S
      -   T  V  R  A  L  F  F  A  L  M  A  Y  L  R  F  I  *  V  I  V
14761 - TAGGGATGACATTACGCTTAGTATACGCGAAAAGTGCATCTTGATCCTCATAACTCATTG - 14820
      - *  G  *  H  Y  A  *  Y  T  R  K  V  H  L  D  P  H  N  S  L
      -  R  D  D  I  T  L  S  I  R  E  K  C  I  L  I  L  I  T  H  *
      -   G  M  T  L  R  L  V  Y  A  K  S  A  S  *  S  S  *  L  I  E
14821 - AGTCATAATAAAGTCTAGCCTTACCCCATTTATTAAATGGGAAACCAGCTGATTTATCCA - 14880
      - S  H  N  K  V  *  P  Y  P  I  Y  *  M  G  N  Q  L  I  Y  P
      -  V  I  I  K  S  S  L  T  P  F  I  K  W  E  T  S  *  F  I  Q
      -   S  *  *  S  L  A  L  P  H  L  L  N  G  K  P  A  D  L  S  R
14881 - GATTGTTAACGATTACTTGGTTGGCATTAATACAGCCACCATCGTAACAATCAAAGTATT - 14940
      - D  C  *  R  L  L  G  W  H  *  Y  S  H  H  R  N  N  Q  S  I
      -  I  V  N  D  Y  L  V  G  I  N  T  A  T  I  V  T  I  K  V  F
      -   L  L  T  I  T  W  L  A  L  I  Q  P  P  S  *  Q  S  K  Y  L
14941 - TATCAACAACTTCAACTACGAATAGGAGTTGTCTGATATCACACATTGTTGGCAGATTAT - 15000
      - Y  Q  Q  L  Q  L  R  I  G  V  V  *  Y  H  T  L  L  A  D  Y
      -  I  N  N  F  N  Y  E  *  E  L  S  D  I  T  H  C  W  Q  I  I
      -   S  T  T  S  T  T  N  R  S  C  L  I  S  H  I  V  G  R  L  *
15001 - AACGATAATAGTCATAATCACTGATAGCAGCGTTGCCATCCTGAGCAAAGAAGAAGTGTT - 15060
      - N  D  N  S  H  N  H  *  *  Q  R  C  H  P  E  Q  R  R  S  V
      -  T  I  I  V  I  I  T  D  S  S  V  A  I  L  S  K  E  E  V  F
      -   R  *  *  S  *  S  L  I  A  A  L  P  S  *  A  K  K  K  C  F
15061 - TTAGTTCAACAGAACTTCCTTCCTTAAAGAAACCTTTAGACACAGCAAAGTCATAAAAGT - 15120
      - L  V  Q  Q  N  F  L  P  *  R  N  L  *  T  Q  Q  S  H  K  S
      -  *  F  N  R  T  S  F  L  K  E  T  F  R  H  S  K  V  I  K  V
      -   S  S  T  E  L  P  S  L  K  K  P  L  D  T  A  K  S  *  K  S
```

FIG. 12 Con't

```
15121 - CTTTATTAAAATTACCGGGTTTGACAGTTTGAAAAGCAACATTGTTTGTTAGTGCAGCTA - 15180
      -  L  Y  *  N  Y  R  V  *  Q  F  E  K  Q  H  C  L  L  V  Q  L
      -  F  I  K  I  T  G  F  D  S  L  K  S  N  I  V  C  *  C  S  Y
      -  L  L  K  L  P  G  L  T  V  *  K  A  T  L  F  V  S  A  A  T
15181 - CTGAAAAGCATGTAGTGCGTTTATCTAGCAATAAATTGCCAGAAGCTGCATGCATAGCTG - 15240
      -  L  K  S  M  *  C  V  Y  L  A  I  N  C  Q  K  L  H  A  *  L
      -  *  K  A  C  S  A  F  I  *  Q  *  I  A  R  S  C  M  H  S  W
      -  E  K  H  V  V  R  L  S  S  N  K  L  P  E  A  A  C  I  A  G
15241 - GATCAGCAGCATACACTAAAAGTTCCTTGAAACTGAGACGCGAGCTATGTAAGTTTACAT - 15300
      -  D  Q  Q  H  T  L  K  V  P  *  N  *  D  A  S  Y  V  S  L  H
      -  I  S  S  I  H  *  K  F  L  E  T  E  T  R  A  M  *  V  Y  I
      -  S  A  A  Y  T  K  S  S  L  K  L  R  R  E  L  C  K  F  T  S
15301 - CCTGATTATGTACGACTCCTAACTCACGAAAATGGTATCCAGTTGAAACAACAAAAGGAA - 15360
      -  P  D  Y  V  R  L  L  T  H  E  N  G  I  Q  L  K  Q  Q  K  E
      -  L  I  M  Y  D  S  *  L  T  K  M  V  S  S  *  N  N  K  R  N
      -  *  L  C  T  T  P  N  S  R  K  W  Y  P  V  E  T  T  K  G  T
15361 - CACCATCTACAAATATTTTTCTTACTAGTGGTCCAAAACTTGTAGGTGGAAACACAGTAG - 15420
      -  H  H  L  Q  I  F  F  L  L  V  V  Q  N  L  *  V  E  T  Q  *
      -  T  I  Y  K  Y  F  S  Y  *  W  S  K  T  C  R  W  K  H  S  R
      -  P  S  T  N  I  F  L  T  S  G  P  K  L  V  G  G  N  T  V  E
15421 - AAAATAACACATTAAAGTTTGCACAATGAAGGATACACCTATCATCCAAACAGTTAATAC - 15480
      -  K  I  T  H  *  S  L  H  N  E  G  Y  T  Y  H  P  N  S  *  Y
      -  K  *  H  I  K  V  C  T  M  K  D  T  P  I  I  Q  T  V  N  T
      -  N  N  T  L  K  F  A  Q  *  R  I  H  L  S  S  K  Q  L  I  Q
15481 - AATTGGGATGGTATGTCTGGTCCCAATATTTAAAATAACGGTCGAAGAGACAAAGTCTCT - 15540
      -  N  W  D  G  M  S  G  P  N  I  *  N  N  G  R  R  D  K  V  S
      -  I  G  M  V  C  L  V  P  I  F  K  I  T  V  E  E  T  K  S  L
      -  L  G  W  Y  V  W  S  Q  Y  L  K  *  R  S  K  R  Q  S  L  S
15541 - CTTCCGTAAAATCATATTTCAGCAAATCCCACTTAATAAGTGGTTTTGCGAGATCAGCAT - 15600
      -  L  P  *  N  H  I  S  A  N  P  T  *  *  V  V  L  R  D  Q  H
      -  F  R  K  I  I  F  Q  Q  I  P  L  N  K  W  F  C  E  I  S  I
      -  S  V  K  S  Y  F  S  K  S  H  L  I  S  G  F  A  R  S  A  S
15601 - CCATATGGGACTCAGCAGCCAATGCCCTAGTCAAAGTGAGGATGGGCATCAGCAATGAGT - 15660
      -  P  Y  G  T  Q  Q  P  M  P  *  S  K  *  G  W  A  S  A  M  S
      -  H  M  G  L  S  S  Q  C  P  S  Q  S  E  D  G  H  Q  Q  *  V
      -  I  W  D  S  A  A  N  A  L  V  K  V  R  M  G  I  S  N  E  *
15661 - AATATGAATCCACAATAGGAACTCCGCAGCCTGGTGCTACTTGTACGAAATCACCGAAAT - 15720
      -  N  M  N  P  Q  *  E  L  R  S  L  V  L  L  V  R  N  H  R  N
      -  I  *  I  H  N  R  N  S  A  A  W  C  Y  L  Y  E  I  T  E  I
      -  Y  E  S  T  I  G  T  P  Q  P  G  A  T  C  T  K  S  P  K  S
15721 - CGTACCAGTTCCCATTAAGATCCTGATTATCTAATGTCAGTACGCCTACAATGCCTGCAT - 15780
      -  R  T  S  S  H  *  D  P  D  Y  L  M  S  V  R  L  Q  C  L  H
      -  V  P  V  P  I  K  I  L  I  I  *  C  Q  Y  A  Y  N  A  C  I
      -  Y  Q  F  P  L  R  S  *  L  S  N  V  S  T  P  T  M  P  A  S
15781 - CACGCATAGCATCGCAGAATTGTACAGTCTTTAATAATGATTGGCGTACACGCTCACCTA - 15840
      -  H  A  *  H  R  R  I  V  Q  S  L  I  M  I  G  V  H  A  H  L
      -  T  H  S  I  A  E  L  Y  S  L  *  *  *  L  A  Y  T  L  T  *
      -  R  I  A  S  Q  N  C  T  V  F  N  N  D  W  R  T  R  S  P  K
15841 - AGTTAGCATATACGCGTAAGATGTCAGGATTCTCTACGAAGTCATACCAATCCTTCTTAT - 15900
      -  S  *  H  I  R  V  R  C  Q  D  S  L  R  S  H  T  N  P  S  Y
      -  V  S  I  Y  A  *  D  V  R  I  L  Y  E  V  I  P  I  L  L  I
      -  L  A  Y  T  R  K  M  S  G  F  S  T  K  S  Y  Q  S  F  L  L
15901 - TGAAATAATCATCATCACAGCAATTGTATGTGACGAGTATTTCTTTTAATGTATCACAAT - 15960
      -  *  N  N  H  H  H  S  N  C  M  *  R  V  F  L  L  M  Y  H  N
      -  E  I  I  I  I  T  A  I  V  C  D  E  Y  F  F  *  C  I  T  I
      -  K  *  S  S  S  Q  Q  L  Y  V  T  S  I  S  F  N  V  S  Q  L
```

FIG. 12 Con't

```
15961 - TACCCTCATCAAAATGACGTAGAGCATAGACTAAATCAGCCATTGTGTATTTAGTTAGAC - 16020
       - Y  P  H  Q  N  D  V  E  H  R  L  N  Q  P  L  C  I  *  L  D
       -  T  L  I  K  M  T  *  S  I  D  *  I  S  H  C  V  F  S  *  T
       -   P  S  S  K  *  R  R  A  *  T  K  S  A  I  V  Y  L  V  R  R
16021 - GCTGACGTGATATATGTGGTACCATGTCACCATCTACTCTAAACTTGAAAAAGTCATGGA - 16080
       - A  D  V  I  Y  V  V  P  C  H  H  L  L  *  T  *  K  S  H  G
       -  L  T  *  Y  M  W  Y  H  V  T  I  Y  S  K  L  E  K  V  M  D
       -   *  R  D  I  C  G  T  M  S  P  S  T  L  N  L  K  K  S  W  T
16081 - CAGCAACCGCTGGACAATCTTTAACCAAGTTATAAATAGTCTCTTCATGTTGGTAGTTAG - 16140
       - Q  Q  P  L  D  N  L  *  P  S  Y  K  *  S  L  H  V  G  S  *
       -  S  N  R  W  T  I  F  N  Q  V  I  N  S  L  F  M  L  V  V  R
       -   A  T  A  G  Q  S  L  T  K  L  *  I  V  S  S  C  W  *  L  D
16141 - ACATAGTATGCCTCTTAACTACAAAGTAAGAGTCTAATAAATTGCCTTCCTCATCCTTCT - 16200
       - T  *  Y  A  S  *  L  Q  S  K  S  L  I  N  C  L  P  H  P  S
       -  H  S  M  P  L  N  Y  K  V  R  V  *  *  I  A  F  L  I  L  L
       -   I  V  C  L  L  T  T  K  *  E  S  N  K  L  P  S  S  S  F  S
16201 - CCTGGAAGCGACAGCAATTAGTTTTTAGGAACTTTGCAAAACCAGCACTTTTTTCGTTGT - 16260
       - P  G  S  D  S  N  *  F  L  G  T  L  Q  N  Q  H  F  F  R  C
       -  L  E  A  T  A  I  S  F  *  E  L  C  K  T  S  T  F  F  V  V
       -   W  K  R  Q  Q  L  V  F  R  N  F  A  K  P  A  L  F  S  L  *
16261 - AAATATCAAAAGCCCTGTAGACGACATCAGTACTAGTGCCTGTGCCGCACGGTGTAAGAC - 16320
       - K  Y  Q  K  P  C  R  R  H  Q  Y  *  C  L  C  R  T  V  *  D
       -  N  I  K  S  P  V  D  D  I  S  T  S  A  C  A  A  R  C  K  T
       -   I  S  K  A  L  *  T  T  S  V  L  V  P  V  P  H  G  V  R  R
16321 - GGGCTGCACTTACACCGCAAACCCGTTTAAAAACGTTGATGCATCCGCAGACTGCATCAA - 16380
       - G  L  H  L  H  R  K  P  V  *  K  R  *  C  I  R  R  L  H  Q
       -  G  C  T  Y  T  A  N  P  F  K  N  V  D  A  S  A  D  C  I  K
       -   A  A  L  T  P  Q  T  R  L  K  T  L  M  H  P  Q  T  A  S  R
16381 - GGGTTCGCGGAGTTGGTCACAACTACAGCCATAACCTTTCCACATTCCGCAGACGGTACA - 16440
       - G  F  A  E  L  V  T  T  T  A  I  T  F  P  H  S  A  D  G  T
       -  G  S  R  S  W  S  Q  L  Q  P  *  P  F  H  I  P  Q  T  V  Q
       -   V  R  G  V  G  H  N  Y  S  H  N  L  S  T  F  R  R  R  Y  R
16441 - GACTGTGTTTCTAAGTGTAAAACCCACTGGGTCATTAGCACAAGTGGTAGGTATTTGGAC - 16500
       - D  C  V  S  K  C  K  T  H  W  V  I  S  T  S  G  R  Y  L  D
       -  T  V  F  L  S  V  K  P  T  G  S  L  A  Q  V  V  G  I  W  T
       -   L  C  F  *  V  *  N  P  L  G  H  *  H  K  W  *  V  F  G  R
16501 - GTACTTACCTTTCAAGTCACAGAATCCTTTAGGATTTGGATGGTCAATGTGGCATCTACA - 16560
       - V  L  T  F  Q  V  T  E  S  F  R  I  W  M  V  N  V  A  S  T
       -  Y  L  P  F  K  S  Q  N  P  L  G  F  G  W  S  M  W  H  L  Q
       -   T  Y  L  S  S  H  R  I  L  *  D  L  D  G  Q  C  G  I  Y  N
16561 - ATACAGACAACATGAAGCACCACCAAAGGACTCTTGGTCCATGTTAGCTTCTGGTGTTAC - 16620
       - I  Q  T  T  *  S  T  T  K  G  L  L  V  H  V  S  F  W  C  Y
       -  Y  R  Q  H  E  A  P  P  K  D  S  W  S  M  L  A  S  G  V  T
       -   T  D  N  M  K  H  H  Q  R  T  L  G  P  C  *  L  L  V  L  Q
16621 - AGTAATTGCCTGTCCTGTACCAGTGTGTGTACACAACATCTTCACACAGTTGGTGATTGG - 16680
       - S  N  C  L  S  C  T  S  V  C  T  Q  H  L  H  T  V  G  D  W
       -  V  I  A  C  P  V  P  V  C  V  H  N  I  F  T  Q  L  V  I  G
       -   *  L  P  V  L  Y  Q  C  V  Y  T  T  S  S  H  S  W  *  L  V
16681 - TTGTCCTCCACTTGCTAGGTAATCCTTATATGCTTTAGCAGGGTCTACTGCAAAAGCACA - 16740
       - L  S  S  T  C  *  V  I  L  I  C  F  S  R  V  Y  C  K  S  T
       -  C  P  P  L  A  R  *  S  L  Y  A  L  A  G  S  T  A  K  A  Q
       -   V  L  H  L  L  G  N  P  Y  M  L  *  Q  G  L  L  Q  K  H  R
16741 - GAAGGAAAGCACAGTTGAATTGGCAGGTACTTCTGTAGCATTTCCAGCCTGAAGACGTAC - 16800
       - E  G  K  H  S  *  I  G  R  Y  F  C  S  I  S  S  L  K  T  Y
       -  K  E  S  T  V  E  L  A  G  T  S  V  A  F  P  A  *  R  R  T
       -   R  K  A  Q  L  N  W  Q  V  L  L  *  H  F  Q  P  E  D  V  L
```

FIG. 12 Con't

```
16801 - TGTAGCAGCTAAACTGCCCAGCACCATACCTCTATTTAGGTTGTTTAAGCCTTTGATGAA - 16860
       - C  S  S  *  T  A  Q  H  H  T  S  I  *  V  V  *  A  F  D  E
       - V  A  A  K  L  P  S  T  I  P  L  F  R  L  F  K  P  L  M  K
       - *  Q  L  N  C  P  A  P  Y  L  Y  L  G  C  L  S  L  *  *  S
16861 - GTACAAGTATTTCACTTTAGGCCCTTTTGGTGTGTCTGTAACAAACCTACAAGGTGGTTC - 16920
       - V  Q  V  F  H  F  R  P  F  W  C  V  C  N  K  P  T  R  W  F
       - Y  K  Y  F  T  L  G  P  F  G  V  S  V  T  N  L  Q  G  G  S
       - T  S  I  S  L  *  A  L  L  V  C  L  *  Q  T  Y  K  V  V  P
16921 - CAGTTCTGTGTAAATTGTACCTGTACCATCACTCTTAGGGAATCTAGCCCATTTGAGATC - 16980
       - Q  F  C  V  N  C  T  C  T  I  T  L  R  E  S  S  P  F  E  I
       - S  S  V  *  I  V  P  V  P  S  L  L  G  N  L  A  H  L  R  S
       - V  L  C  K  L  Y  L  Y  H  H  S  *  G  I  *  P  I  *  D  L
16981 - TTGGTGGTCTGATAGTAATGCCAGCACAAACCTACCTCCCTTCGAATTGTTATAGTAGGC - 17040
       - L  V  V  *  *  *  C  Q  H  K  P  T  S  L  R  I  V  I  V  G
       - W  W  S  D  S  N  A  S  T  N  L  P  P  F  E  L  L  *  *  A
       - G  G  L  I  V  M  P  A  Q  T  Y  L  P  S  N  C  Y  S  R  Q
17041 - AAGTGCATTGTCATCAGTACAAGCTGTTTGTGTGGTACCAGCCGCACAGGACATCTGTCG - 17100
       - K  C  I  V  I  S  T  S  C  L  C  G  T  S  R  T  G  H  L  S
       - S  A  L  S  S  V  Q  A  V  C  V  V  P  A  A  Q  D  I  C  R
       - V  H  C  H  Q  Y  K  L  F  V  W  Y  Q  P  H  R  T  S  V  V
17101 - TAGTGCTACTGGACTCAGTTCATTATTCTGTAGTTTAACAGCTGAGTTGGCTCTTAGAGC - 17160
       - *  C  Y  W  T  Q  F  I  I  L  *  F  N  S  *  V  G  S  *  S
       - S  A  T  G  L  S  S  L  F  C  S  L  T  A  E  L  A  L  R  A
       - V  L  L  D  S  V  H  Y  S  V  V  *  Q  L  S  W  L  L  E  L
17161 - TGTAACAATAAGAGGCCAAGCCAAATTTGGTGAATTGTCCATGTTAATTTCACTAAGTTG - 17220
       - C  N  N  K  R  P  S  Q  I  W  *  I  V  H  V  N  F  T  K  L
       - V  T  I  R  G  Q  A  K  F  G  E  L  S  M  L  I  S  L  S  *
       - *  Q  *  E  A  K  P  N  L  V  N  C  P  C  *  F  H  *  V  E
17221 - AACAATCTTGCTATCCGCATCAACAACTTGCTGGATTTCCCAGAGTGCAGATGCATATGT - 17280
       - N  N  L  A  I  R  I  N  N  L  L  D  F  P  E  C  R  C  I  C
       - T  I  L  L  S  A  S  T  T  C  W  I  S  Q  S  A  D  A  Y  V
       - Q  S  C  Y  P  H  Q  Q  L  A  G  F  P  R  V  Q  M  H  M  *
17281 - AAAGGTGTTACCATCACAAGTGTTCTTGTAGGTACCATAATCAGGGACAACAACCATGAG - 17340
       - K  G  V  T  I  T  S  V  L  V  G  T  I  I  R  D  N  N  H  E
       - K  V  L  P  S  Q  V  F  L  *  V  P  *  S  G  T  T  T  M  S
       - R  C  Y  H  H  K  C  S  C  R  Y  H  N  Q  G  Q  Q  P  *  V
17341 - TTTGGCTGCTGTAGTCAATGGTATGATGTTGAGTGGAACACAACCATCACGCGCATTGTT - 17400
       - F  G  C  C  S  Q  W  Y  D  V  E  W  N  T  T  I  T  R  I  V
       - L  A  A  V  V  N  G  M  M  L  S  G  T  Q  P  S  R  A  L  L
       - W  L  L  *  S  M  V  *  C  *  V  E  H  N  H  H  A  H  C  *
17401 - GATAATGTTGTTAAGTGCATCATTATCAAGCTTCCTAAGCATAGTGAAGAGCATTGTTTG - 17460
       - D  N  V  V  K  C  I  I  I  K  L  P  K  H  S  E  E  H  C  L
       - I  M  L  L  S  A  S  L  S  S  F  L  S  I  V  K  S  I  V  C
       - *  C  C  *  V  H  H  Y  Q  A  S  *  A  *  *  R  A  L  F  A
17461 - CATAGCACTAGTTACTTTTGCCCTCTTGTCCTCAGATCTTGCCTGTTTGTACATTTGGGT - 17520
       - H  S  T  S  Y  F  C  P  L  V  L  R  S  C  L  F  V  H  L  G
       - I  A  L  V  T  F  A  L  L  S  S  D  L  A  C  L  Y  I  W  V
       - *  H  *  L  L  L  P  S  C  P  Q  I  L  P  V  C  T  F  G  S
17521 - CATAGCCTGATCTGCCATCTTTTCCAACTTGCGTTGCATGGCAGCATCACGGTCAAACTC - 17580
       - H  S  L  I  C  H  L  F  Q  L  A  L  H  G  S  I  T  V  K  L
       - I  A  *  S  A  I  F  S  N  L  R  C  M  A  A  S  R  S  N  S
       - *  P  D  L  P  S  F  P  T  C  V  A  W  Q  H  H  G  Q  T  Q
17581 - AGATTTAGCCACATTCAAAGATTTCTTTAACTTTTTGAGAACGACTTCAGAATCACCATT - 17640
       - R  F  S  H  I  Q  R  F  L  *  L  F  E  N  D  F  R  I  T  I
       - D  L  A  T  F  K  D  F  F  N  F  L  R  T  T  S  E  S  P  L
       - I  *  P  H  S  K  I  S  L  T  F  *  E  R  L  Q  N  H  H  *
```

FIG. 12 Con't

```
17641 - AGCTACAGCCTGCTCATAGGCCTCCTGGGCAGTGGCATAAGCGGCATATGATGGTAAAGA - 17700
      - S  Y  S  L  L  I  G  L  L  G  S  G  I  S  G  I  *  W  *  R
      -  A  T  A  C  S  *  A  S  W  A  V  A  *  A  A  Y  D  G  K  E
      -   L  Q  P  A  H  R  P  P  G  Q  W  H  K  R  H  M  M  V  K  N
17701 - ACTAAATTCTGAAGCAATAGCCTGAAGAGTAGCACGGTTATCGAGCATTTCCTCGCACAA - 17760
      - T  K  F  *  S  N  S  L  K  S  S  T  V  I  E  H  F  L  A  Q
      -  L  N  S  E  A  I  A  *  R  V  A  R  L  S  S  I  S  S  H  N
      -   *  I  L  K  Q  *  P  E  E  *  H  G  Y  R  A  F  P  R  T  T
17761 - CCTATTAATGTCTACAGCACCCTGCATGGATAGCAAAACAGACAAAAGAGAAACCATCTT - 17820
      - P  I  N  V  Y  S  T  L  H  G  *  Q  N  R  Q  K  R  N  H  L
      -  L  L  M  S  T  A  P  C  M  D  S  K  T  D  K  R  E  T  I  F
      -   Y  *  C  L  Q  H  P  A  W  I  A  K  Q  T  K  E  K  P  S  S
17821 - CTCGAAAGCTTCAGTTGTGTCTTTTGCAAGAAGAATATCATTGTGGAGTTGTACACATTG - 17880
      - L  E  S  F  S  C  V  F  C  K  K  N  I  I  V  E  L  Y  T  L
      -  S  K  A  S  V  V  S  F  A  R  R  I  S  L  W  S  C  T  H  C
      -   R  K  L  Q  L  C  L  L  Q  E  E  Y  H  C  G  V  V  H  I  V
17881 - TGCCCACAATTTAGAAGATGACTCTACTCTAAGTTGTTGAAGAACCGAGAGCAGTACCAC - 17940
      - C  P  Q  F  R  R  *  L  Y  S  K  L  L  K  N  R  E  Q  Y  H
      -  A  H  N  L  E  D  D  S  T  L  S  C  *  R  T  E  S  S  T  T
      -   P  T  I  *  K  M  T  L  L  *  V  V  E  E  P  R  A  V  P  Q
17941 - AGATGTGCACTTTACGTCAGACATTTTAGACTGTACAGTAGCAACCTTGATACATGGTTT - 18000
      - R  C  A  L  Y  V  R  H  F  R  L  Y  S  S  N  L  D  T  W  F
      -  D  V  H  F  T  S  D  I  L  D  C  T  V  A  T  L  I  H  G  L
      -   M  C  T  L  R  Q  T  F  *  T  V  Q  *  Q  P  *  Y  M  V  Y
18001 - ACCTCCAATACCCAACAACTTAATGTTAAGCTTGAAAGCATCAATACTACTCTTAGGAGG - 18060
      - T  S  N  T  Q  Q  L  N  V  K  L  E  S  I  N  T  T  L  R  R
      -  P  P  I  P  N  N  L  M  L  S  L  K  A  S  I  L  L  L  G  G
      -   L  Q  Y  P  T  T  *  C  *  A  *  K  H  Q  Y  Y  S  *  E  A
18061 - CAAAAGCCCCTGGGAGTTCATATACCTAAATTCTTGTGTAGAGACCAAGTAGTCATAAAC - 18120
      - Q  K  P  L  G  V  H  I  P  K  F  L  C  R  D  Q  V  V  I  N
      -  K  S  P  W  E  F  I  Y  L  N  S  C  V  E  T  K  *  S  *  T
      -   K  A  P  G  S  S  Y  T  *  I  L  V  *  R  P  S  S  H  K  H
18121 - ACCAAGAGTAAGCCTGAAGTAACGGTTGAGTAAACAGAAAAGGCCAAAGTAGCAGCAGCA - 18180
      - T  K  S  K  P  E  V  T  V  E  *  T  E  K  A  K  V  A  A  A
      -  P  R  V  S  L  K  *  R  L  S  K  Q  K  R  P  K  *  Q  Q  Q
      -   Q  E  *  A  *  S  N  G  *  V  N  R  K  G  Q  S  S  S  S  N
18181 - ACAATAGCCTAAGAAACAATAAACAAGCATGATACACTGTAAGGTGTTGCCAGTAATAAA - 18240
      - T  I  A  *  E  T  I  N  K  H  D  T  L  *  G  V  A  S  N  K
      -  Q  *  P  K  K  Q  *  T  S  M  I  H  C  K  V  L  P  V  I  N
      -   N  S  L  R  N  N  K  Q  A  *  Y  T  V  R  C  C  Q  *  *  I
18241 - TAACAATGGGTAATACTCAACACACACAAACACTATAGCTCTAGCTAAAAACATGATAGT - 18300
      - *  Q  W  V  I  L  N  T  H  K  H  Y  S  S  S  *  K  H  D  S
      -  N  N  G  *  Y  S  T  H  T  N  T  I  A  L  A  K  N  M  I  V
      -   T  M  G  N  T  Q  H  T  Q  T  L  *  L  *  L  K  T  *  *  S
18301 - CGTAACGACACCAGAATAGTTAGAGGTTACAGAAATAACTAAGGCCCACATGGAAATAGC - 18360
      - R  N  D  T  R  I  V  R  G  Y  R  N  N  *  G  P  H  G  N  S
      -  V  T  T  P  E  *  L  E  V  T  E  I  T  K  A  H  M  E  I  A
      -   *  R  H  Q  N  S  *  R  L  Q  K  *  L  R  P  T  W  K  *  L
18361 - TTGATCTAAAGCATTACCATAGTAGACTTTGTAAACAAGTGTAATGACATTCATCAGTGT - 18420
      - L  I  *  S  I  T  I  V  D  F  V  N  K  C  N  D  I  H  Q  C
      -  *  S  K  A  L  P  *  *  T  L  *  T  S  V  M  T  F  I  S  V
      -   D  L  K  H  Y  H  S  R  L  C  K  Q  V  *  *  H  S  S  V  S
18421 - CCAAACACGTCTAGCAGCATCATCATAAACAGTGCGAGCTGTCATGAGAATAAGCAAAAC - 18480
      - P  N  T  S  S  S  I  I  I  N  S  A  S  C  H  E  N  K  Q  N
      -  Q  T  R  L  A  A  S  S  *  T  V  R  A  V  M  R  I  S  K  T
      -   K  H  V  *  Q  H  H  H  K  Q  C  E  L  S  *  E  *  A  K  L
```

FIG. 12 Con't

```
18481 - TAAAGCTGAAGCATACATAACACAATCCTTAAGCCTATAACCAGACAAGCTAGTGTCAGC - 18540
       - *  S  *  S  I  H  N  T  I  L  K  P  I  T  R  Q  A  S  V  S
       -    K  A  E  A  Y  I  T  Q  S  L  S  L  *  P  D  K  L  V  S  A
       -       K  L  K  H  T  *  H  N  P  *  A  Y  N  Q  T  S  *  C  Q  P
18541 - CAATTCAAGCCATGTCATGATACGCATCACCCAGCTAGCAGGCATGTAGACCATATTAAA - 18600
       - Q  F  K  P  C  H  D  T  H  H  P  A  S  R  H  V  D  H  I  K
       - N  S  S  H  V  M  I  R  I  T  Q  L  A  G  M  *  T  I  L  K
       -    I  Q  A  M  S  *  Y  A  S  P  S  *  Q  A  C  R  P  Y  *  S
18601 - GTAAGCAACTGTTGCAAGAGAAGGTAACAGAAACAAGCACAAGAATGCGTGCTTATGCTT - 18660
       - V  S  N  C  C  K  R  R  *  Q  K  Q  A  Q  E  C  V  L  M  L
       - *  A  T  V  A  R  E  G  N  R  N  K  H  K  N  A  C  L  C  L
       -    K  Q  L  L  Q  E  K  V  T  E  T  S  T  R  M  R  A  Y  A  *
18661 - AACAAGCAGCATAGCACATGCAGCAATTGCCATAATACCAAGAGTAAATGGCAAGAAAGC - 18720
       - N  K  Q  H  S  T  C  S  N  C  H  N  T  K  S  K  W  Q  E  S
       - T  S  S  I  A  H  A  A  I  A  I  I  P  R  V  N  G  K  K  A
       -    Q  A  A  *  H  M  Q  Q  L  P  *  Y  Q  E  *  M  A  R  K  H
18721 - ATTCTCGTAAACAAAGAAAAACAGTGACCACTGTGTACTTTGAACAAGAATCAATAGTGA - 18780
       - I  L  V  N  K  E  K  Q  *  P  L  C  T  L  N  K  N  Q  *  *
       - F  S  *  T  K  K  N  S  D  H  C  V  L  *  T  R  I  N  S  D
       -    S  R  K  Q  R  K  T  V  T  T  V  Y  F  E  Q  E  S  I  V  M
18781 - TGTCAAGAAAGTTAAAAGCATCCAATGATGAGTGCCCTTAACAATTTTCTTGAACTTACC - 18840
       - C  Q  E  S  *  K  H  P  M  M  S  A  L  N  N  F  L  E  L  T
       - V  K  K  V  K  S  I  Q  *  *  V  P  L  T  I  F  L  N  L  P
       -    S  R  K  L  K  A  S  N  D  E  C  P  *  Q  F  S  *  T  Y  L
18841 - TTGGAAGGTAACACCAGAGCATTGTCTAACAACATCAAATGGTGTAAACTCATCTTCTAA - 18900
       - L  E  G  N  T  R  A  L  S  N  N  I  K  W  C  K  L  I  F  *
       - W  K  V  T  P  E  H  C  L  T  T  S  N  G  V  N  S  S  S  K
       -    G  R  *  H  Q  S  I  V  *  Q  H  Q  M  V  *  T  H  L  L  K
18901 - AATAGTGCTACCAAGGATAGTACGACCATTCATACCATTCTGCAGCAGCTCTTTCAAAGC - 18960
       - N  S  A  T  K  D  S  T  T  I  H  T  I  L  Q  Q  L  F  Q  S
       -    I  V  L  P  R  I  V  R  P  F  I  P  F  C  S  S  S  F  K  A
       -       *  C  Y  Q  G  *  Y  D  H  S  Y  H  S  A  A  A  L  S  K  Q
18961 - AGCACACATATCTAAGACGGCAATTCCTGTTTGAGCAGAAAGAGGTCCCAATATGTCAAC - 19020
       - S  T  H  I  *  D  G  N  S  C  L  S  R  K  R  S  Q  Y  V  N
       -    A  H  I  S  K  T  A  I  P  V  *  A  E  R  G  P  N  M  S  T
       -       H  T  Y  L  R  R  Q  F  L  F  E  Q  K  E  V  P  I  C  Q  H
19021 - ATGATCTTGTGTCAAAGGTTCATAGTTGTACTTCATTGCCACAAGGTTAAAGTCATTCAA - 19080
       - M  I  L  C  Q  R  F  I  V  V  L  H  C  H  K  V  K  V  I  Q
       - *  S  C  V  K  G  S  *  L  Y  F  I  A  T  R  L  K  S  F  K
       -    D  L  V  S  K  V  H  S  C  T  S  L  P  Q  G  *  S  H  S  K
19081 - AGTAGTGGTGAATCTATTAAGAAACCACCTATCACCATTGATAACAGCAGCATACAGCCA - 19140
       - S  S  G  E  S  I  K  K  P  P  I  T  I  D  N  S  S  I  Q  P
       - V  V  V  N  L  L  R  N  H  L  S  P  L  I  T  A  A  Y  S  H
       -    *  W  *  I  Y  *  E  T  T  Y  H  H  *  *  Q  Q  H  T  A  M
19141 - TGCCAAAACATTTAATGTTATGGTTGTGTCTGTACCTGCAGCCTGTGCAGTTTGTCTGTC - 19200
       - C  Q  N  I  *  C  Y  G  C  V  C  T  C  S  L  C  S  L  S  V
       - A  K  T  F  N  V  M  V  V  S  V  P  A  A  C  A  V  C  L  S
       -    P  K  H  L  M  L  W  L  C  L  Y  L  Q  P  V  Q  F  V  C  Q
19201 - AACAAATGGACCATAGAATTTACCTTCTAAGTCAGTACCAGCGTGTACTCCTGTTGGAAG - 19260
       - N  K  W  T  I  E  F  T  F  *  V  S  T  S  V  Y  S  C  W  K
       - T  N  G  P  *  N  L  P  S  K  S  V  P  A  C  T  P  V  G  S
       -    Q  M  D  H  R  I  Y  L  L  S  Q  Y  Q  R  V  L  L  L  E  A
19261 - CTCCATATGATGCATATAGCAGAAAGACACGCAATCATAATCAATGTTAAAACCAACACT - 19320
       - L  H  M  M  H  I  A  E  R  H  A  I  I  I  N  V  K  T  N  T
       - S  I  *  C  I  *  Q  K  D  T  Q  S  *  S  M  L  K  P  T  L
       -    P  Y  D  A  Y  S  R  K  T  R  N  H  N  Q  C  *  N  Q  H  Y
```

FIG. 12 Con't

```
19321 - ACCACATGATCCATTAAGGAAAGAACCTTTAATGGTATGATTAGGTCTCATGGCACACTG - 19380
      - T  T  *  S  I  K  E  R  T  F  N  G  M  I  R  S  H  G  T  L
      - P  H  D  P  L  R  K  E  P  L  M  V  *  L  G  L  M  A  H  *
      - H  M  I  H  *  G  K  N  L  *  W  Y  D  *  V  S  W  H  T  D
19381 - ATAAACACCAGATGGTGAACCATTGTAGCATGCTAGAACTGAAAATGTTTGACCAGGTTG - 19440
      - I  N  T  R  W  *  T  I  V  A  C  *  N  *  K  C  L  T  R  L
      - *  T  P  D  G  E  P  L  *  H  A  R  T  E  N  V  *  P  G  W
      - K  H  Q  M  V  N  H  C  S  M  L  E  L  K  M  F  D  Q  V  G
19441 - GATACGGACAAATTTATACTTGGGTGTCTTAGGGTTAGAAGTATCAACTTTAAGCCTAAG - 19500
      - D  T  D  K  F  I  L  G  C  L  R  V  R  S  I  N  F  K  P  K
      - I  R  T  N  L  Y  L  G  V  L  G  L  E  V  S  T  L  S  L  S
      - Y  G  Q  I  Y  T  W  V  S  *  G  *  K  Y  Q  L  *  A  *  A
19501 - CAGACAATTTTGCATAGAATGGCCAATAACACGAAGTTGAACATTGCCAGCCTGAACAAG - 19560
      - Q  T  I  L  H  R  M  A  N  N  T  K  L  N  I  A  S  L  N  K
      - R  Q  F  C  I  E  W  P  I  T  R  S  *  T  L  P  A  *  T  R
      - D  N  F  A  *  N  G  Q  *  H  E  V  E  H  C  Q  P  E  Q  E
19561 - AAAGCTATGGTTGGATTTGCGAATGAGCAGATCTTCATAGTTAGGATTAAGCATGTCTTC - 19620
      - K  A  M  V  G  F  A  N  E  Q  I  F  I  V  R  I  K  H  V  F
      - K  L  W  L  D  L  R  M  S  R  S  S  *  L  G  L  S  M  S  S
      - S  Y  G  W  I  C  E  *  A  D  L  H  S  *  D  *  A  C  L  L
19621 - TGCTGTGCAAATGACATGTCTTGGACAGTATACTGTGTCATCCAACCACAATCCATTAAG - 19680
      - C  C  A  N  D  M  S  W  T  V  Y  C  V  I  Q  P  Q  S  I  K
      - A  V  Q  M  T  C  L  G  Q  Y  T  V  S  S  N  H  N  P  L  R
      - L  C  K  *  H  V  L  D  S  I  L  C  H  P  T  T  I  H  *  E
19681 - AGTTGTAGTTCCACAGGTTACTTGTACCATGCACCCTTCAACTTTGCCTGACGGGAATGC - 19740
      - S  C  S  S  T  G  Y  L  Y  H  A  P  F  N  F  A  *  R  E  C
      - V  V  V  P  Q  V  T  C  T  M  H  P  S  T  L  P  D  G  N  A
      - L  *  F  H  R  L  L  V  P  C  T  L  Q  L  C  L  T  G  M  P
19741 - CATTTTCCTAAAACCACTCTGCAGAACAGCAGAAGTGATTGATGTCTGTGGTGGTTGGTA - 19800
      - H  F  P  K  T  T  L  Q  N  S  R  S  D  *  C  L  W  W  L  V
      - I  F  L  K  P  L  C  R  T  A  E  V  I  D  V  C  G  G  W  *
      - F  S  *  N  H  S  A  E  Q  Q  K  *  L  M  S  V  V  V  G  R
19801 - GAGAACATCAGCACCTGAGTTGCTAAAGTCATTTAGAGCCTTTGCTAAGTGGCAGCAAGC - 19860
      - E  N  I  S  T  *  V  A  K  V  I  *  S  L  C  *  V  A  A  S
      - R  T  S  A  P  E  L  L  K  S  F  R  A  F  A  K  W  Q  Q  A
      - E  H  Q  H  L  S  C  *  S  H  L  E  P  L  L  S  G  S  K  L
19861 - TGCTTCACGATAGCTGGTAGTATCTAAGGCTCCACTGAAATACTTGTACTTGTTATATAG - 19920
      - C  F  T  I  A  G  S  I  *  G  S  T  E  I  L  V  L  V  I  *
      - A  S  R  *  L  V  V  S  K  A  P  L  K  Y  L  Y  L  L  Y  R
      - L  H  D  S  W  *  Y  L  R  L  H  *  N  T  C  T  C  Y  I  E
19921 - AGCAAGATACCTGTTATACTGTGTAAGTGGCAACAGTGTCTCGCTACGCAATTTTAGGTA - 19980
      - S  K  I  P  V  I  L  C  K  W  Q  Q  C  L  A  T  Q  F  *  V
      - A  R  Y  L  L  Y  C  V  S  G  N  S  V  S  L  R  N  F  R  Y
      - Q  D  T  C  Y  T  V  *  V  A  T  V  S  R  Y  A  I  L  G  T
19981 - CATTTCCTTGTTGAGCAAAAAGGTACACAAAGCAGCCTCCTCGAAGGTACTAAATGTAAC - 20040
      - H  F  L  V  E  Q  K  G  T  Q  S  S  L  L  E  G  T  K  C  N
      - I  S  L  L  S  K  K  V  H  K  A  A  S  S  K  V  L  N  V  T
      - F  P  C  *  A  K  R  Y  T  K  Q  P  P  R  R  Y  *  M  *  L
20041 - TCCATTAAACATGACTCTTTTCCTAAGATAGTTGTTAAAGAACCAATGGCAGTGCTTCAG - 20100
      - S  I  K  H  D  S  F  P  K  I  V  V  K  E  P  M  A  V  L  Q
      - P  L  N  M  T  L  F  L  R  *  L  L  K  N  Q  W  Q  C  F  R
      - H  *  T  *  L  F  S  *  D  S  C  *  R  T  N  G  S  A  S  E
20101 - AGAAATACAGAATACATAGATTGCTGTTATCCAAAAAGGCACAATAGGAGAAAACATGGC - 20160
      - R  N  T  E  Y  I  D  C  C  Y  P  K  R  H  N  R  R  K  H  G
      - E  I  Q  N  T  *  I  A  V  I  Q  K  G  T  I  G  E  N  M  A
      - K  Y  R  I  H  R  L  L  L  S  K  K  A  Q  *  E  K  T  W  Q
```

FIG. 12 Con't

```
20161 - AAACCATTGAAGGTGAGCCAAGAATGAAACATCATTGGTGAAATAGAATGTCAAGTACAA - 20220
       - K  P  L  K  V  S  Q  E  *  N  I  I  G  E  I  E  C  Q  V  Q
       - N  H  *  R  *  A  K  N  E  T  S  L  V  K  *  N  V  K  Y  K
       - T  I  E  G  E  P  R  M  K  H  H  W  *  N  R  M  S  S  T  S
20221 - GTAAAAGACTGAGTAGACTCCCGGCAGAAAGCTGTAAGCTGGTACCAGACAGAGTATAGT - 20280
       - V  K  D  *  V  D  S  R  Q  K  A  V  S  W  Y  Q  T  E  Y  S
       - *  K  T  E  *  T  P  G  R  K  L  *  A  G  T  R  Q  S  I  V
       - K  R  L  S  R  L  P  A  E  S  C  K  L  V  P  D  R  V  *  *
20281 - GAAAGACATCAAAAACAAAAGTGCATTAGCAGCAACAACATGGTTGTACTCACCAAAAAC - 20340
       - E  R  H  Q  K  Q  K  C  I  S  S  N  N  M  V  V  L  T  K  N
       - K  D  I  K  N  K  S  A  L  A  A  T  T  W  L  Y  S  P  K  T
       - K  T  S  K  T  K  V  H  *  Q  Q  Q  H  G  C  T  H  Q  K  H
20341 - ACGTCTGAATTTCATAAAGTAGTAGGCAGCACAAGTCACCAATATGGCAATAATACCACC - 20400
       - T  S  E  F  H  K  V  V  G  S  T  S  H  Q  Y  G  N  N  T  T
       - R  L  N  F  I  K  *  *  A  A  Q  V  T  N  M  A  I  I  P  P
       - V  *  I  S  *  S  S  R  Q  H  K  S  P  I  W  Q  *  Y  H  Q
20401 - AGCCACTACTGAAGCAGACACATCTAAAGCACCCACAGGTTGCACAAGAGGAGTAAAGAT - 20460
       - S  H  Y  *  S  R  H  I  *  S  T  H  R  L  H  K  R  S  K  D
       - A  T  T  E  A  D  T  S  K  A  P  T  G  C  T  R  G  V  K  M
       - P  L  L  K  Q  T  H  L  K  H  P  Q  V  A  Q  E  E  *  R  C
20461 - GTTAGCTATGAGATTCATCGCATCAACACCACAGAAAACTCCTGATAGAGCTCTGTAATG - 20520
       - V  S  Y  E  I  H  R  I  N  T  T  E  N  S  *  *  S  S  V  M
       - L  A  M  R  F  I  A  S  T  P  Q  K  T  P  D  R  A  L  *  C
       - *  L  *  D  S  S  H  Q  H  H  R  K  L  L  I  E  L  C  N  A
20521 - CTCATTATTAAGAACCCATCTACCACTGGTAGATAGGCAAATACCTACTTCTGACCTTTC - 20580
       - L  I  I  K  N  P  S  T  T  G  R  *  A  N  T  Y  F  *  P  F
       - S  L  L  R  T  H  L  P  L  V  D  R  Q  I  P  T  S  D  L  S
       - H  Y  *  E  P  I  Y  H  W  *  I  G  K  Y  L  L  L  T  F  R
20581 - GCATGTACCATGTCTACAGTACTCAGCATCAAAAGTTGTTACTACTCTAACAGAACCCTC - 20640
       - A  C  T  M  S  T  V  L  S  I  K  S  C  Y  Y  S  N  R  T  L
       - H  V  P  C  L  Q  Y  S  A  S  K  V  V  T  T  L  T  E  P  S
       - M  Y  H  V  Y  S  T  Q  H  Q  K  L  L  L  L  *  Q  N  P  P
20641 - CAGGTAAGTGTTAGGAAACTGTATGATGGAACCATCCATAAGCACATAACGAGTGTCTGG - 20700
       - Q  V  S  V  R  K  L  Y  D  G  T  I  H  K  H  I  T  S  V  W
       - R  *  V  L  G  N  C  M  M  E  P  S  I  S  T  *  R  V  S  G
       - G  K  C  *  E  T  V  *  W  N  H  P  *  A  H  N  E  C  L  D
20701 - ACGAAGCTCACTATAAGAAATAGAACCCTCTAGCAAATTAGTGTCATAACAATATGGCAC - 20760
       - T  K  L  T  I  R  N  R  T  L  *  Q  I  S  V  I  T  I  W  H
       - R  S  S  L  *  E  I  E  P  S  S  K  L  V  S  *  Q  Y  G  T
       - E  A  H  Y  K  K  *  N  P  L  A  N  *  C  H  N  N  M  A  Q
20761 - AGGTTTGCCCATAGCATCCTTAAAAATTGTACACTCAGCAGCAAGAACGCAAGCAGAGGT - 20820
       - R  F  A  H  S  I  L  K  N  C  T  L  S  S  K  N  A  S  R  G
       - G  L  P  I  A  S  L  K  I  V  H  S  A  A  R  T  Q  A  E  V
       - V  C  P  *  H  P  *  K  L  Y  T  Q  Q  Q  E  R  K  Q  R  *
20821 - AGCAAAATCACTATACTCAATGAGTTTGGAAGGTGTGTAGCAAATGTTGCCAACAGCACT - 20880
       - S  K  I  T  I  L  N  E  F  G  R  C  V  A  N  V  A  N  S  T
       - A  K  S  L  Y  S  M  S  L  E  G  V  *  Q  M  L  P  T  A  L
       - Q  N  H  Y  T  Q  *  V  W  K  V  C  S  K  C  C  Q  Q  H  *
20881 - AAAAACACGAGGTAGAAAATGCAAGAAGTCACCATTGATTGCTCTCAGCACAGTACCCGG - 20940
       - K  N  T  R  *  K  M  Q  E  V  T  I  D  C  S  Q  H  S  T  R
       - K  T  R  G  R  K  C  K  K  S  P  L  I  A  L  S  T  V  P  G
       - K  H  E  V  E  N  A  R  S  H  H  *  L  L  S  A  Q  Y  P  V
20941 - TAAGCCAGGCACTATGAAACCAATCTCTCTTGTAATGATAGCAGCTACTACAGGGCAGCT - 21000
       - *  A  R  H  Y  E  T  N  L  S  C  N  D  S  S  Y  Y  R  A  A
       - K  P  G  T  M  K  P  I  S  L  V  M  I  A  A  T  T  G  Q  L
       - S  Q  A  L  *  N  Q  S  L  L  *  *  *  Q  L  L  Q  G  S  F
```

FIG. 12 Con't

```
21001 - TTTGTCATTTTTGTATGAACCACCACGCTGGCTAAACCATGCGTCAAAACCAGCATGTTT - 21060
      - F  V  I  F  V  *  T  T  T  L  A  K  P  C  V  K  T  S  M  F
      -  L  S  F  L  Y  E  P  P  R  W  L  N  H  A  S  K  P  A  C  L
      -   C  H  F  C  M  N  H  H  A  G  *  T  M  R  Q  N  Q  H  V  Y
21061 - ATTTGCAAAACAATCATCAGTAGAAATGATGTCACGAGTGACACCATCCTGAATGGCTTT - 21120
      - I  C  K  T  I  I  S  R  N  D  V  T  S  D  T  I  L  N  G  F
      -  F  A  K  Q  S  S  V  E  M  M  S  R  V  T  P  S  *  M  A  L
      -   L  Q  N  N  H  Q  *  K  *  C  H  E  *  H  H  P  E  W  L  C
21121 - GTAACCAATGATTTCATTTGTGTAACCATCATGGATTGACAATGTATGTACTGGCATAAC - 21180
      - V  T  N  D  F  I  C  V  T  I  M  D  *  Q  C  M  Y  W  H  N
      -  *  P  M  I  S  F  V  *  P  S  W  I  D  N  V  C  T  G  I  T
      -   N  Q  *  F  H  L  C  N  H  H  G  L  T  M  Y  V  L  A  *  R
21181 - GATATAACAAACCAATGCAGCAAGAACGCACAATAATGTGGCCTTAAGCATAAGTTTAAA - 21240
      - D  I  T  N  Q  C  S  K  N  A  Q  *  C  G  L  K  H  K  F  K
      -  I  *  Q  T  N  A  A  R  T  H  N  N  V  A  L  S  I  S  L  K
      -   Y  N  K  P  M  Q  Q  E  R  T  I  M  W  P  *  A  *  V  *  N
21241 - ACAAGTACTAACAATCTTACCACCCTTGAGTGAGATTTTAGTAGTTATGACATTGACAAC - 21300
      - T  S  T  N  N  L  T  T  L  E  *  D  F  S  S  Y  D  I  D  N
      -  Q  V  L  T  I  L  P  P  L  S  E  I  L  V  V  M  T  L  T  T
      -   K  Y  *  Q  S  Y  H  P  *  V  R  F  *  *  L  *  H  *  Q  P
21301 - CTGTCTAGTTGTAGCACAAGTTAGTGTAAAAGGTATGTTGTTCTTCTTGGCAGCAGTACG - 21360
      - L  S  S  C  S  T  S  *  C  K  R  Y  V  V  L  L  G  S  S  T
      -  C  L  V  V  A  Q  V  S  V  K  G  M  L  F  F  L  A  A  V  R
      -   V  *  L  *  H  K  L  V  *  K  V  C  C  S  S  W  Q  Q  Y  E
21361 - AATTTGTTTACGCAGCTGTTCAGATAAAGACATGTAGTCTTTTACATTCCAGATGAGTGA - 21420
      - N  L  F  T  Q  L  F  R  *  R  H  V  V  F  Y  I  P  D  E  *
      -  I  C  L  R  S  C  S  D  K  D  M  *  S  F  T  F  Q  M  S  E
      -   F  V  Y  A  A  V  Q  I  K  T  C  S  L  L  H  S  R  *  V  K
21421 - AACATTGTGACTTTTTGCTACTTGGGCATTGATATGCCTTGCATTACAGTCAATACATGC - 21480
      - N  I  V  T  F  C  Y  L  G  I  D  M  P  C  I  T  V  N  T  C
      -  T  L  *  L  F  A  T  W  A  L  I  C  L  A  L  Q  S  I  H  A
      -   H  C  D  F  L  L  L  G  H  *  Y  A  L  H  Y  S  Q  Y  M  R
21481 - GCCAAGATCTCTGGGCGTCATGTTTTCAACCTTATTATAGGTGAGCATGAAATTGTTACA - 21540
      - A  K  I  S  G  R  H  V  F  N  L  I  I  G  E  H  E  I  V  T
      -  P  R  S  L  G  V  M  F  S  T  L  L  *  V  S  M  K  L  L  Q
      -   Q  D  L  W  A  S  C  F  Q  P  Y  Y  R  *  A  *  N  C  Y  N
21541 - ACTGTCACCTGTCACTTCTAAGTCAGAGTGATGTGAAAGTTTGAGACATTCAATAACATC - 21600
      - T  V  T  C  H  F  *  V  R  V  M  *  K  F  E  T  F  N  N  I
      -  L  S  P  V  T  S  K  S  E  *  C  E  S  L  R  H  S  I  T  S
      -   C  H  L  S  L  L  S  Q  S  D  V  K  V  *  D  I  Q  *  H  P
21601 - CTTTGTGTCAACATCGGTATCAACAACACCTTGTCGGGCAGCTGACACGAATGTAGAAAG - 21660
      - L  C  V  N  I  G  I  N  N  T  L  S  G  S  *  H  E  C  R  K
      -  F  V  S  T  S  V  S  T  T  P  C  R  A  A  D  T  N  V  E  R
      -   L  C  Q  H  R  Y  Q  Q  H  L  V  G  Q  L  T  R  M  *  K  G
21661 - GACACCATCTAAAGCTACACCCTTTGCTAACTCGCTGTGAGCTGTAGCAACAAGTGCCTT - 21720
      - D  T  I  *  S  Y  T  L  C  *  L  A  V  S  C  S  N  K  C  L
      -  T  P  S  K  A  T  P  F  A  N  S  L  *  A  V  A  T  S  A  L
      -   H  H  L  K  L  H  P  L  L  T  R  C  E  L  *  Q  Q  V  P  *
21721 - AAGTTTTTCCATAGGAACACTAAAAGTTGCTGAAAAGGTGTCGACATAAGCATCAAACAT - 21780
      - K  F  F  H  R  N  T  K  S  C  *  K  G  V  D  I  S  I  K  H
      -  S  F  S  I  G  T  L  K  V  A  E  K  V  S  T  *  A  S  N  I
      -   V  F  P  *  E  H  *  K  L  L  K  R  C  R  H  K  H  Q  T  S
21781 - CTTAACGGAAACTTCAGTACTATCTCCAACGTTTGATACAAGAGCTTGGTCAAGCAACAG - 21840
      - L  N  G  N  F  S  T  I  S  N  V  *  Y  K  S  L  V  K  Q  Q
      -  L  T  E  T  S  V  L  S  P  T  F  D  T  R  A  W  S  S  N  R
      -   *  R  K  L  Q  Y  Y  L  Q  R  L  I  Q  E  L  G  Q  A  T  E
```

FIG. 12 Con't

```
21841 - AATAGGTTGGCACATCAGCTGACTGTAGTACACAGAAGCAGACTTAGAAGCAGACTCGTC - 21900
      - N  R  L  A  H  Q  L  T  V  V  H  R  S  R  L  R  S  R  L  V
      -  I  G  W  H  I  S  *  L  *  Y  T  E  A  D  L  E  A  D  S  S
      -   *  V  G  T  S  A  D  C  S  T  Q  K  Q  T  *  K  Q  T  R  R
21901 - GCATTTGGACTTGCCATCAAAAACTATGACATTAATAGGCAGTGAACCTTTAGTGTTGTT - 21960
      - A  F  G  L  A  I  K  N  Y  D  I  N  R  Q  *  T  F  S  V  V
      -  H  L  D  L  P  S  K  T  M  T  L  I  G  S  E  P  L  V  L  L
      -   I  W  T  C  H  Q  K  L  *  H  *  *  A  V  N  L  *  C  C  *
21961 - AGCTCTCAAATTGTCTAAATTGACAAAATGGGAGAGCGGATGTCTCTCATAGGTCTTTTG - 22020
      - S  S  Q  I  V  *  I  D  K  M  G  E  R  M  S  L  I  G  L  L
      -  A  L  K  L  S  K  L  T  K  W  E  S  G  C  L  S  *  V  F  *
      -   L  S  N  C  L  N  *  Q  N  G  R  A  D  V  S  H  R  S  F  D
22021 - ACCAGCCTTGTCAAAGTAGAGGTGAAGCGCGCCATTTTTCACAGCAACACTATCAACAAT - 22080
      - T  S  L  V  K  V  E  V  K  R  A  I  F  H  S  N  T  I  N  N
      -  P  A  L  S  K  *  R  *  S  A  P  F  F  T  A  T  L  S  T  I
      -   Q  P  C  Q  S  R  G  E  A  R  H  F  S  Q  Q  H  Y  Q  Q  Y
22081 - ATACGATGACTGGTCAGTAGGGTTGATTGGTCTTTTAAACTGGAGTGACAAATCACGAGC - 22140
      - I  R  *  L  V  S  R  V  D  W  S  F  K  L  E  *  Q  I  T  S
      -  Y  D  D  W  S  V  G  L  I  G  L  L  N  W  S  D  K  S  R  A
      -   T  M  T  G  Q  *  G  *  L  V  F  *  T  G  V  T  N  H  E  Q
22141 - AACTTCATCACTAATGAATGTACTACCAGTGCAAAATGTGTCACAATTGAGACAATTCCA - 22200
      - N  F  I  T  N  E  C  T  T  S  A  K  C  V  T  I  E  T  I  P
      -  T  S  S  L  M  N  V  L  P  V  Q  N  V  S  Q  L  R  Q  F  Q
      -   L  H  H  *  *  M  Y  Y  Q  C  K  M  C  H  N  *  D  N  S  N
22201 - ATTGTGAGTCTTGCAGAAGCCACGGCCTCCATTTGCATAGACATAGAAAGATCTCTTCAT - 22260
      - I  V  S  L  A  E  A  T  A  S  I  C  I  D  I  E  R  S  L  H
      -  L  *  V  L  Q  K  P  R  P  P  F  A  *  T  *  K  D  L  F  M
      -   C  E  S  C  R  S  H  G  L  H  L  H  R  H  R  K  I  S  S  C
22261 - GCCATTAACAATAGTTGTACACTCAACGCGTGTGGCACGATTGCGCTTATAGCACATCAT - 22320
      - A  I  N  N  S  C  T  L  N  A  C  G  T  I  A  L  I  A  H  H
      -  P  L  T  I  V  V  H  S  T  R  V  A  R  L  R  L  *  H  I  M
      -   H  *  Q  *  L  Y  T  Q  R  V  W  H  D  C  A  Y  S  T  S  C
22321 - GCAAGTCGAAGAGGTGCAACCATCCATGATATGAACATAGCTCTTCCATATGTAGTAGAA - 22380
      - A  S  R  R  G  A  T  I  H  D  M  N  I  A  L  P  Y  V  V  E
      -  Q  V  E  E  V  Q  P  S  M  I  *  T  *  L  F  H  M  *  *  K
      -   K  S  K  R  C  N  H  P  *  Y  E  H  S  S  S  I  C  S  R  K
22381 - AGAAGCAAAGAAGATGTACATCCTAACCATTGCAGAAACGGGTGCCATTTGTACAATACT - 22440
      - R  S  K  E  D  V  H  P  N  H  C  R  N  G  C  H  L  Y  N  T
      -  E  A  K  K  M  Y  I  L  T  I  A  E  T  G  A  I  C  T  I  L
      -   K  Q  R  R  C  T  S  *  P  L  Q  K  R  V  P  F  V  Q  Y  *
22441 - AATGATAAACCACATGAGCCAAGAATTGCTGATGAAATGACTAGCAAAATAGCCAAAGAA - 22500
      - N  D  K  P  H  E  P  R  I  A  D  E  M  T  S  K  I  A  K  E
      -  M  I  N  H  M  S  Q  E  L  L  M  K  *  L  A  K  *  P  K  N
      -   *  *  T  T  *  A  K  N  C  *  *  N  D  *  Q  N  S  Q  R  T
22501 - CACCTGCATTATAGCTGAAAGACCTAATAAATAAAAGAATTTTGTGAACAACATATATGC - 22560
      - H  L  H  Y  S  *  K  T  *  *  I  K  E  F  C  E  Q  H  I  C
      -  T  C  I  I  A  E  R  P  N  K  *  K  N  F  V  N  N  I  Y  A
      -   P  A  L  *  L  K  D  L  I  N  K  R  I  L  *  T  T  Y  M  P
22561 - CAAAACCCACTCAGCGGCCAGACCTAAAATTGTCAAGTCTAGCTTGTACGATGAAATCGT - 22620
      - Q  N  P  L  S  G  Q  T  *  N  C  Q  V  *  L  V  R  *  N  R
      -  K  T  H  S  A  A  R  P  K  I  V  K  S  S  L  Y  D  E  I  V
      -   K  P  T  Q  R  P  D  L  K  L  S  S  L  A  C  T  M  K  S  S
22621 - CACCTGAATGGTTTCAAGAGCTGGATAAGAATCAAGGGAGTCTAATCCACTTAAACAAAT - 22680
      - H  L  N  G  F  K  S  W  I  R  I  K  G  V  *  S  T  *  T  N
      -  T  *  M  V  S  R  A  G  *  E  S  R  E  S  N  P  L  K  Q  M
      -   P  E  W  F  Q  E  L  D  K  N  Q  G  S  L  I  H  L  N  K  C
```

FIG. 12 Con't

```
22681 - GCTGCAAGGAAAAGAACCTTCACAGAAATCCATAGTAGTAACGTTAGACGAATTAAGATA - 22740
       - A  A  R  K  R  T  F  T  E  I  H  S  S  N  V  R  R  I  K  I
       -  L  Q  G  K  E  P  S  Q  K  S  I  V  V  T  L  D  E  L  R  Y
       -   C  K  E  K  N  L  H  R  N  P  *  *  *  R  *  T  N  *  D  T
22741 - CAATTCTCTAACGCCATTACAATAAGAAGGAGCACCAAAATTAGATAAGAGTACACCAAA - 22800
       - Q  F  S  N  A  I  T  I  R  R  S  T  K  I  R  *  E  Y  T  K
       -  N  S  L  T  P  L  Q  *  E  G  A  P  K  L  D  K  S  T  P  K
       -   I  L  *  R  H  Y  N  K  K  E  H  Q  N  *  I  R  V  H  Q  K
22801 - AGCAGCAGTTACACAGATTAGAGAACCTAAGCAAATACTTAACAACAATAGCCACATAGC - 22860
       - S  S  S  Y  T  D  *  R  T  *  A  N  T  *  Q  Q  *  P  H  S
       -  A  A  V  T  Q  I  R  E  P  K  Q  I  L  N  N  N  S  H  I  A
       -   Q  Q  L  H  R  L  E  N  L  S  K  Y  L  T  T  I  A  T  *  R
22861 - GATTGTGAACAATTTAGAAAATTTGGGTGACTTCACATAATTAATGCCGGCATCCAAACA - 22920
       - D  C  E  Q  F  R  K  F  G  *  L  H  I  I  N  A  G  I  Q  T
       -  I  V  N  N  L  E  N  L  G  D  F  T  *  L  M  P  A  S  K  H
       -   L  *  T  I  *  K  I  W  V  T  S  H  N  *  C  R  H  P  N  I
22921 - TAATTTAGCAACACTCTTAACACTATTTTTAGCAATAGTTGTAGGTAGTGAAGCTCTAAT - 22980
       - *  F  S  N  T  L  N  T  I  F  S  N  S  C  R  *  *  S  S  N
       -  N  L  A  T  L  L  T  L  F  L  A  I  V  V  G  S  E  A  L  I
       -   I  *  Q  H  S  *  H  Y  F  *  Q  *  L  *  V  V  K  L  *  F
22981 - TCTAGAATTGGTACTTTTAGTAAAAGTACACAATTGGAACAATAATGTAAACACATAAGG - 23040
       - S  R  I  G  T  F  S  K  S  T  Q  L  E  Q  *  C  K  H  I  R
       -  L  E  L  V  L  L  V  K  V  H  N  W  N  N  N  V  N  T  *  G
       -   *  N  W  Y  F  *  *  K  Y  T  I  G  T  I  M  *  T  H  K  A
23041 - CATATAATTGTTAAACACACGTTGTGCTAATCTCTTAGCGCAATTTGATGTTGTAATTGC - 23100
       - H  I  I  V  K  H  T  L  C  *  S  L  S  A  I  *  C  C  N  C
       -  I  *  L  L  N  T  R  C  A  N  L  L  A  Q  F  D  V  V  I  A
       -   Y  N  C  *  T  H  V  V  L  I  S  *  R  N  L  M  L  *  L  L
23101 - TGCTTGTCCTAAGAATGGTTTGACATAAGCCAAAATTTTACTCCAAGGAACACTATTAAT - 23160
       - C  L  S  *  E  W  F  D  I  S  Q  N  F  T  P  R  N  T  I  N
       -  A  C  P  K  N  G  L  T  *  A  K  I  L  L  Q  G  T  L  L  I
       -   L  V  L  R  M  V  *  H  K  P  K  F  Y  S  K  E  H  Y  *  L
23161 - TGCAGCAATACCATGAGTGGCAATTGTTTTTAAACCTAAGGCTAGTGAAAGCTCATTAGG - 23220
       - C  S  N  T  M  S  G  N  C  F  *  T  *  G  *  *  K  L  I  R
       -  A  A  I  P  *  V  A  I  V  F  K  P  K  A  S  E  S  S  L  G
       -   Q  Q  Y  H  E  W  Q  L  F  L  N  L  R  L  V  K  A  H  *  V
23221 - TTTCTTAATGGTAATGCTTGTGTTTTCCACATAAGCAGCCATAAGATCCTCATGACCTAA - 23280
       - F  L  N  G  N  A  C  V  F  H  I  S  S  H  K  I  L  M  T  *
       -  F  L  M  V  M  L  V  F  S  T  *  A  A  I  R  S  S  *  P  N
       -   S  *  W  *  C  L  C  F  P  H  K  Q  P  *  D  P  H  D  L  T
23281 - CTCTTGTGTTACTTTAACACCTTCATCTGATGGTTTAAGTATGACATTGCCTACAACTTC - 23340
       - L  L  C  Y  F  N  T  F  I  *  W  F  K  Y  D  I  A  Y  N  F
       -  S  C  V  T  L  T  P  S  S  D  G  L  S  M  T  L  P  T  T  S
       -   L  V  L  L  *  H  L  H  L  M  V  *  V  *  H  C  L  Q  L  R
23341 - GGTAGTTTTCACGTCACACTCTATGACTTCCTTCTGTATGGTAGGATTTTCCACTACTTC - 23400
       - G  S  F  H  V  T  L  Y  D  F  L  L  Y  G  R  I  F  H  Y  F
       -  V  V  F  T  S  H  S  M  T  S  F  C  M  V  G  F  S  T  T  S
       -   *  F  S  R  H  T  L  *  L  P  S  V  W  *  D  F  P  L  L  L
23401 - TTCAGAGGTGGGTTGTTGACTTTCACAAGCAAGATTGTCCATTCCTTGTGTGTCTTCTAC - 23460
       - F  R  G  G  L  L  T  F  T  S  K  I  V  H  S  L  C  V  F  Y
       -  S  E  V  G  C  *  L  S  Q  A  R  L  S  I  P  C  V  S  S  T
       -   Q  R  W  V  V  D  F  H  K  Q  D  C  P  F  L  V  C  L  L  L
23461 - TGCCAGAACTTCAAATGAATTTGAAGTATCTACTGGCTTTGTACTCCAAAGACAACGTAA - 23520
       - C  Q  N  F  K  *  I  *  S  I  Y  W  L  C  T  P  K  T  T  *
       -  A  R  T  S  N  E  F  E  V  S  T  G  F  V  L  Q  R  Q  R  K
       -   P  E  L  Q  M  N  L  K  Y  L  L  A  L  Y  S  K  D  N  V  N
```

FIG. 12 Con't

```
23521 - ACACCAAGTGTTTGGTTTGAACGTTGTCTTGGTTGTAGCCTGGTTAATGTGCCAAACAAT - 23580
       - T  P  S  V  W  F  E  R  C  L  G  C  S  L  V  N  V  P  N  N
       -  H  Q  V  F  G  L  N  V  V  L  V  V  A  W  L  M  C  Q  T  I
       -   T  K  C  L  V  *  T  L  S  W  L  *  P  G  *  C  A  K  Q  L
23581 - TGGCTTATGCAGTAATTTAGCACCTTTCTTGAAACTCGCTGAATAGTGTCTATAGTCAAT - 23640
       - W  L  M  Q  *  F  S  T  F  L  E  T  R  *  I  V  S  I  V  N
       -  G  L  C  S  N  L  A  P  F  L  K  L  A  E  *  C  L  *  S  I
       -   A  Y  A  V  I  *  H  L  S  *  N  S  L  N  S  V  Y  S  Q  *
23641 - AGCCACTACATCGCCATTCAAGTCTGGGAAGAATGTGACAGATAGCTCTCGTGAAGCTGG - 23700
       - S  H  Y  I  A  I  Q  V  W  E  E  C  D  R  *  L  S  *  S  W
       -  A  T  T  S  P  F  K  S  G  K  N  V  T  D  S  S  R  E  A  G
       -   P  L  H  R  H  S  S  L  G  R  M  *  Q  I  A  L  V  K  L  A
23701 - CTTTGTGAAGCCTGTCATTTGATTTAAATCATCAGCAAATTTTGTGTTAGAACATGTGAG - 23760
       - L  C  E  A  C  H  L  I  *  I  I  S  K  F  C  V  R  T  C  E
       -  F  V  K  P  V  I  *  F  K  S  S  A  N  F  V  L  E  H  V  S
       -   L  *  S  L  S  F  D  L  N  H  Q  Q  I  L  C  *  N  M  *  V
23761 - TTTGAAATTATCAAAACTCGCATTTGGTAATGGTTGAGTTGGTACAAGGTCTATAGGCTG - 23820
       - F  E  I  I  K  T  R  I  W  *  W  L  S  W  Y  K  V  Y  R  L
       -  L  K  L  S  K  L  A  F  G  N  G  *  V  G  T  R  S  I  G  C
       -   *  N  Y  Q  N  S  H  L  V  M  V  E  L  V  Q  G  L  *  A  A
23821 - CTCTGTATAGTAAGCATTATCCTTTTTATAATACCCATCCAATTTTGGTTCAATCTCTGT - 23880
       - L  C  I  V  S  I  I  L  F  I  I  P  I  Q  F  W  F  N  L  C
       -  S  V  *  *  A  L  S  F  L  *  Y  P  S  N  F  G  S  I  S  V
       -   L  Y  S  K  H  Y  P  F  Y  N  T  H  P  I  L  V  Q  S  L  C
23881 - GTAAGTAACTCCATCGAGTTTATACGACACAGGCTTGATGGTTGTAGTGTAAGATGTTTC - 23940
       - V  S  N  S  I  E  F  I  R  H  R  L  D  G  C  S  V  R  C  F
       -  *  V  T  P  S  S  L  Y  D  T  G  L  M  V  V  V  *  D  V  S
       -   K  *  L  H  R  V  Y  T  T  Q  A  *  W  L  *  C  K  M  F  P
23941 - CTTGTAGAAAACATCAGTCACTGGTCCTTTGTACTCTGACATCTTTGTAAGGTGAGCTCC - 24000
       - L  V  E  N  I  S  H  W  S  F  V  L  *  H  L  C  K  V  S  S
       -  L  *  K  T  S  V  T  G  P  L  Y  S  D  I  F  V  R  *  A  P
       -   C  R  K  H  Q  S  L  V  L  C  T  L  T  S  L  *  G  E  L  R
24001 - GTCAATACGATAGAGGGTCTCCTTAGCAGTTATATGAGTGTAATGACCACACTGATAGTT - 24060
       - V  N  T  I  E  G  L  L  S  S  Y  M  S  V  M  T  T  L  I  V
       -  S  I  R  *  R  V  S  L  A  V  I  *  V  *  *  P  H  *  *  L
       -   Q  Y  D  R  G  S  P  *  Q  L  Y  E  C  N  D  H  T  D  S  Y
24061 - ACCAGTGTACTCATTCGCACATAAGAATGTACCTTGCTGTAATTTATACTCAGCAGGTGG - 24120
       - T  S  V  L  I  R  T  *  E  C  T  L  L  *  F  I  L  S  R  W
       -  P  V  Y  S  F  A  H  K  N  V  P  C  C  N  L  Y  S  A  G  G
       -   Q  C  T  H  S  H  I  R  M  Y  L  A  V  I  Y  T  Q  Q  V  V
24121 - TGCAGACATCATAACAAAAGAAGACTCTTGTTGTACTAGATATTGTGTAGCATCACGACC - 24180
       - C  R  H  H  N  K  R  R  L  L  L  Y  *  I  L  C  S  I  T  T
       -  A  D  I  I  T  K  E  D  S  C  C  T  R  Y  C  V  A  S  R  P
       -   Q  T  S  *  Q  K  K  T  L  V  V  L  D  I  V  *  H  H  D  H
24181 - ACACACACATGGAATGGAAACACCTGTCTTAAGATTATCATAAGATAGAGTACCCATATA - 24240
       - T  H  T  W  N  G  N  T  C  L  K  I  I  I  R  *  S  T  H  I
       -  H  T  H  G  M  E  T  P  V  L  R  L  S  *  D  R  V  P  I  Y
       -   T  H  M  E  W  K  H  L  S  *  D  Y  H  K  I  E  Y  P  Y  T
24241 - CATCACAGCTTCTACACCCGTTAAGGTAGTAGTTTTCTGACCACAATGTTTACACACCAC - 24300
       - H  H  S  F  Y  T  R  *  G  S  S  F  L  T  T  M  F  T  H  H
       -  I  T  A  S  T  P  V  K  V  V  V  F  *  P  Q  C  L  H  T  T
       -   S  Q  L  L  H  P  L  R  *  *  F  S  D  H  N  V  Y  T  P  H
24301 - ATTAAGAACTCGCTTTGCAGATTCCAAATTAGCATGCTGTAGAAGATGGGTCATAGTTTC - 24360
       - I  K  N  S  L  C  R  F  Q  I  S  M  L  *  K  M  G  H  S  F
       -  L  R  T  R  F  A  D  S  K  L  A  C  C  R  R  W  V  I  V  S
       -   *  E  L  A  L  Q  I  P  N  *  H  A  V  E  D  G  S  *  F  L
```

FIG. 12 Con't

```
24361 - TCTGACATCACCAAGCTCGCCAACAGTTTTATTACTGTAAGCGAGTATGAGTGCACAAAA - 24420
      - S  D  I  T  K  L  A  N  S  F  I  T  V  S  E  Y  E  C  T  K
      -  L  T  S  P  S  S  P  T  V  L  L  L  *  A  S  M  S  A  Q  K
      -   *  H  H  Q  A  R  Q  Q  F  Y  Y  C  K  R  V  *  V  H  K  S
24421 - GTTAGCAGCATCACCAGCACGGGCTCTATAATAAGCCTCTTGAAGTGCTGGTGCATTGAA - 24480
      - V  S  S  I  T  S  T  G  S  I  I  S  L  L  K  C  W  C  I  E
      -  L  A  A  S  P  A  R  A  L  *  *  A  S  *  S  A  G  A  L  N
      -   *  Q  H  H  Q  H  G  L  Y  N  K  P  L  E  V  L  V  H  *  I
24481 - TTTGACTTCAAGCTGTTGAAGTGCTAATAAAACACTAGACAAATAACAATTGTTATCAGC - 24540
      - F  D  F  K  L  L  K  C  *  *  N  T  R  Q  I  T  I  V  I  S
      -  L  T  S  S  C  *  S  A  N  K  T  L  D  K  *  Q  L  L  S  A
      -   *  L  Q  A  V  E  V  L  I  K  H  *  T  N  N  C  Y  Q  P
24541 - CCATTTAATTGAAGTTAAACCACCAACTTGAGGAAATTTCCATTTCTTTGTGTGGTTTAA - 24600
      - P  F  N  *  S  *  T  T  N  L  R  K  F  P  F  L  C  V  V  *
      -  H  L  I  E  V  K  P  P  T  *  G  N  F  H  F  F  V  W  F  K
      -   I  *  L  K  L  N  H  Q  L  E  E  I  S  I  S  L  C  G  L  K
24601 - AGCAGACATGTACCTACCAAGAAAACTCTCATCAAGAGTATGGTAGTACTCGAAAGCTTC - 24660
      - S  R  H  V  P  T  K  K  T  L  I  K  S  M  V  V  L  E  S  F
      -  A  D  M  Y  L  P  R  K  L  S  S  R  V  W  *  Y  S  K  A  S
      -   Q  T  C  T  Y  Q  E  N  S  H  Q  E  Y  G  S  T  R  K  L  H
24661 - ACTACGTAGTGTGTCATCACTAGGTAGTACAAAGAAAGTCTTACCCTCATGATTTACATG - 24720
      - T  T  *  C  V  I  T  R  *  Y  K  E  S  L  T  L  M  I  Y  M
      -  L  R  S  V  S  S  L  G  S  T  K  K  V  L  P  S  *  F  T  *
      -   Y  V  V  C  H  H  *  V  V  Q  R  K  S  Y  P  H  D  L  H  E
24721 - AGGTTTAATTTTTGTAACATCAGCACCATCCAAGTATGTTGGACCAAACTGCTGTCCATA - 24780
      - R  F  N  F  C  N  I  S  T  I  Q  V  C  W  T  K  L  L  S  I
      -  G  L  I  F  V  T  S  A  P  S  K  Y  V  G  P  N  C  C  P  Y
      -   V  *  F  L  *  H  Q  H  H  P  S  M  L  D  Q  T  A  V  H  M
24781 - TGTCATAGACATATCCACAAGCTGTGTGTGGAGATTAGTGTTGTCCACAGTTGTGAACAC - 24840
      - C  H  R  H  I  H  K  L  C  V  E  I  S  V  V  H  S  C  E  H
      -  V  I  D  I  S  T  S  C  V  W  R  L  V  L  S  T  V  V  N  T
      -   S  *  T  Y  P  Q  A  V  C  G  D  *  C  C  P  Q  L  *  T  L
24841 - TTTTATAGTCTTAACCTCCCGCAGGGATAAGAGACTCTTTAGTTTGTCAAGTGAAAGAAC - 24900
      - F  Y  S  L  N  L  P  Q  G  *  E  T  L  *  F  V  K  *  K  N
      -  F  I  V  L  T  S  R  R  D  K  R  L  F  S  L  S  S  E  R  T
      -   L  *  S  *  P  P  A  G  I  R  D  S  L  V  C  Q  V  K  E  P
24901 - CTCACCGTCAAGATGAAACTCGACGGGGCTCTCCAGAGTGTGGTACACAATTTTGTCACC - 24960
      - L  T  V  K  M  K  L  D  G  A  L  Q  S  V  V  H  N  F  V  T
      -  S  P  S  R  *  N  S  T  G  L  S  R  V  W  Y  T  I  L  S  P
      -   H  R  Q  D  E  T  R  R  G  S  P  E  C  G  T  Q  F  C  H  H
24961 - ACGCTTAAGAAATTCAACACCTAACTCTGTACGCTGTCCTGAATAGGACCAATCTCTGTA - 25020
      - T  L  K  K  F  N  T  *  L  C  T  L  S  *  I  G  P  I  S  V
      -  R  L  R  N  S  T  P  N  S  V  R  C  P  E  *  D  Q  S  L  *
      -   A  *  E  I  Q  H  L  T  L  Y  A  V  L  N  R  T  N  L  C  K
25021 - AGAGCCAGCCAAAGAAACTGTTTCTACAAAGTGCTCCTCAGATGTCTTTGATGACGAAGT - 25080
      - R  A  S  Q  R  N  C  F  Y  K  V  L  L  R  C  L  *  *  R  S
      -  E  P  A  K  E  T  V  S  T  K  C  S  S  D  V  F  D  D  E  V
      -   S  Q  P  K  K  L  F  L  Q  S  A  P  Q  M  S  L  M  T  K  *
25081 - GAGGTATCCATTATATGTAGTAACAGCATCTGGTGATGATACTGACACTACGGCAGGAGC - 25140
      - E  V  S  I  I  C  S  N  S  I  W  *  *  Y  *  H  Y  G  R  S
      -  R  Y  P  L  Y  V  V  T  A  S  G  D  D  T  D  T  T  A  G  A
      -   G  I  H  Y  M  *  *  Q  H  L  V  M  I  L  T  L  R  Q  E  L
25141 - TTTAAGAGAACGCATACAGCGCGCAGCCTCTTCAAGATTAAAACCATGTGTCACATAACC - 25200
      - F  K  R  T  H  T  A  R  S  L  F  K  I  K  T  M  C  H  I  T
      -  L  R  E  R  I  Q  R  A  A  S  S  R  L  K  P  C  V  T  *  P
      -   *  E  N  A  Y  S  A  Q  P  L  Q  D  *  N  H  V  S  H  N  Q
```

FIG. 12 Con't

```
25201 - AATTGGCATTGTGACAAGCGGCTCATTTAGAGAGTTCAGCTTCGTAATAATAGAAGCTAC - 25260
       - N  W  H  C  D  K  R  L  I  *  R  V  Q  L  R  N  N  R  S  Y
       -  I  G  I  V  T  S  G  S  F  R  E  F  S  F  V  I  I  E  A  T
       -   L  A  L  *  Q  A  A  H  L  E  S  S  A  S  *  *  *  K  L  Q
25261 - AGGCTCTTTACTAGTATAAAAGAAGAATCGGACACCATAGTCAACGATGCCCTCTTGAAT - 25320
       - R  L  F  T  S  I  K  E  E  S  D  T  I  V  N  D  A  L  L  N
       -  G  S  L  L  V  *  K  K  N  R  T  P  *  S  T  M  P  S  *  I
       -   A  L  Y  *  Y  K  R  R  I  G  H  H  S  Q  R  C  P  L  E  F
25321 - TTTAATTCCTTTATACTTACGTTGGATGGTTGCCATTATGGCTCTAACATCCATGCATAT - 25380
       - F  N  S  F  I  L  T  L  D  G  C  H  Y  G  S  N  I  H  A  Y
       -  L  I  P  L  Y  L  R  W  M  V  A  I  M  A  L  T  S  M  H  I
       -   *  F  L  Y  T  Y  V  G  W  L  P  L  W  L  *  H  P  C  I  *
25381 - AGGCATTAATTTTCTTGTCTCTTCAGCATGAGCAAGCATTTCTCTCAAATTCCAGGATAC - 25440
       - R  H  *  F  S  C  L  F  S  M  S  K  H  F  S  Q  I  P  G  Y
       -  G  I  N  F  L  V  S  S  A  *  A  S  I  S  L  K  F  Q  D  T
       -   A  L  I  F  L  S  L  Q  H  E  Q  A  F  L  S  N  S  R  I  Q
25441 - AGTTCCTAGAATCTCTTCCTTAGCATTAGGTGCTTCTGAAGGTAGTACATAAAATGCAGA - 25500
       - S  S  *  N  L  F  L  S  I  R  C  F  *  R  *  Y  I  K  C  R
       -  V  P  R  I  S  S  L  A  L  G  A  S  E  G  S  T  *  N  A  D
       -   F  L  E  S  L  P  *  H  *  V  L  L  K  V  V  H  K  M  Q  I
25501 - TTTGCATTTCTTAAGAGCAGTCTTAGCTTCCTCAAGTGTATAACCAGCACATCCTTGTCC - 25560
       - F  A  F  L  K  S  S  L  S  F  L  K  C  I  T  S  T  S  L  S
       -  L  H  F  L  R  A  V  L  A  S  S  S  V  *  P  A  H  P  C  P
       -   C  I  S  *  E  Q  S  *  L  P  Q  V  Y  N  Q  H  I  L  V  Q
25561 - AGGGTACGTGGTTATATACTCATCAACTGGCACTTTCTTCAAAGCTCTTGAGAGCATCTC - 25620
       - R  V  R  G  Y  I  L  I  N  W  H  F  L  Q  S  S  *  E  H  L
       -  G  Y  V  V  I  Y  S  S  T  G  T  F  F  K  A  L  E  S  I  S
       -   G  T  W  L  Y  T  H  Q  L  A  L  S  S  K  L  L  R  A  S  Q
25621 - AGTAGTGCCACCAGCCTTTTTGGAGGGTATTACAACACAAGTGATATCACCACTAGTGAT - 25680
       - S  S  A  T  S  L  F  G  G  Y  Y  N  T  S  D  I  T  T  S  D
       -  V  V  P  P  A  F  L  E  G  I  T  T  Q  V  I  S  P  L  V  I
       -   *  C  H  Q  P  F  W  R  V  L  Q  H  K  *  Y  H  H  *  *  *
25681 - AACATCACCTACCATGTAAGGTGCATCCTTCTCAAGGAAAGACATATCTTCACCTCTAAG - 25740
       - N  I  T  Y  H  V  R  C  I  L  L  K  E  R  H  I  F  T  S  K
       -  T  S  P  T  M  *  G  A  S  F  S  R  K  D  I  S  S  P  L  S
       -   H  H  L  P  C  K  V  H  P  S  Q  G  K  T  I  Y  L  H  L  * A
25741 - CATGTTCTGAGAATCATGGTAAAGCTTACCATTGATATCAGCAAACAAGAGTAACTTATT - 25800
       - H  V  L  R  I  M  V  K  L  T  I  D  I  S  K  Q  E  *  L  I
       -  M  F  *  E  S  W  *  S  L  P  L  I  S  A  N  K  S  N  L  L
       -   C  S  E  N  H  G  K  A  Y  H  *  Y  Q  Q  T  R  V  T  Y  W
25801 - GGTAAGAAACTTAGTTTCTTCCAGTGTTGTGGTAACCTCATCAATGCAGGCCTTAATTTT - 25860
       - G  K  K  L  S  F  F  Q  C  C  G  N  L  I  N  A  G  L  N  F
       -  V  R  N  L  V  S  S  S  V  V  V  T  S  S  M  Q  A  L  I  F
       -   *  E  T  *  F  L  P  V  L  W  *  P  H  Q  C  R  P  *  F  L
25861 - TGGCTTCACATCGACAGGCTTCTGTACGACAGATTTCTCCTCAGTTTTGGAATCTTCTGT - 25920
       - W  L  H  I  D  R  L  L  Y  D  R  F  L  L  S  F  G  I  F  C
       -  G  F  T  S  T  G  F  C  T  T  D  F  S  S  V  L  E  S  S  V
       -   A  S  H  R  Q  A  S  V  R  Q  I  S  P  Q  F  W  N  L  L  C
25921 - GTTTGGTGGCTCCTCTTGTTTAGGTGCTTCCACTCTAGGCTTCAGGTTATCAAGATAATC - 25980
       - V  W  W  L  L  L  F  R  C  F  H  S  R  L  Q  V  I  K  I  I
       -  F  G  G  S  S  C  L  G  A  S  T  L  G  F  R  L  S  R  *  S
       -   L  V  A  P  L  V  *  V  L  P  L  *  A  S  G  Y  Q  D  N  P
25981 - CATGACAACCTGCTCATAAAGAGCTTTGTCATTGACTGCAATATAAACCTGTGTACGAAC - 26040
       - H  D  N  L  L  I  K  S  F  V  I  D  C  N  I  N  L  C  T  N
       -  M  T  T  C  S  *  R  A  L  S  L  T  A  I  *  T  C  V  R  T
       -   *  Q  P  A  H  K  E  L  C  H  *  L  Q  Y  K  P  V  Y  E  P
```

FIG. 12 Con't

```
26041 - CGTCTGCACGCACACTTGTAAAGACTGAAGTGGTTTAGCACCAAATATGCCTGCTGACAA - 26100
      - R  L  H  A  H  L  *  R  L  K  W  F  S  T  K  Y  A  C  *  Q
      -  V  C  T  H  T  C  K  D  *  S  G  L  A  P  N  M  P  A  D  N
      -   S  A  R  T  L  V  K  T  E  V  V  *  H  Q  I  C  L  L  T  T
26101 - CAATGGTGCAAGTAAGATGTCCTGTGAATTGAAATTTTCATATGCTGCCTTAAGAAGCTG - 26160
      - Q  W  C  K  *  D  V  L  *  I  E  I  F  I  C  C  L  K  K  L
      -  N  G  A  S  K  M  S  C  E  L  K  F  S  Y  A  A  L  R  S  W
      -   M  V  Q  V  R  C  P  V  N  *  N  F  H  M  L  P  *  E  A  G
26161 - GATGTCCTCACCTGCATTTAGGTTAGGTCCAACAACATGCAGACACTTCTTAGCAAGATT - 26220
      - D  V  L  T  C  I  *  V  R  S  N  N  M  Q  T  L  L  S  K  I
      -  M  S  S  P  A  F  R  L  G  P  T  T  C  R  H  F  L  A  R  L
      -   C  P  H  L  H  L  G  *  V  Q  Q  H  A  D  T  S  *  Q  D  Y
26221 - ATGTCCAGAAAGCAAACAAGACCCTCCTACTGTAAGAGGGCCATTTAGCTTAATGTAATC - 26280
      - M  S  R  K  Q  T  R  P  S  Y  C  K  R  A  I  *  L  N  V  I
      -  C  P  E  S  K  Q  D  P  P  T  V  R  G  P  F  S  L  M  *  S
      -   V  Q  K  A  N  K  T  L  L  L  *  E  G  H  L  A  *  C  N  H
26281 - ATCACTCTCCTTTTGCATGGCACCATTGGTTGCCTTGTTGAGTGCACCTGCTACACCACC - 26340
      - I  T  L  L  L  H  G  T  I  G  C  L  V  E  C  T  C  Y  T  T
      -  S  L  S  F  C  M  A  P  L  V  A  L  L  S  A  P  A  T  P  P
      -   H  S  P  F  A  W  H  H  W  L  P  C  *  V  H  L  L  H  H  H
26341 - ACCATGTTTCAGGTGTATGTTAGCAGCATTTACAATCACCATAGGATTAGCACTTTGTGC - 26400
      - T  M  F  Q  V  Y  V  S  S  I  Y  N  H  H  R  I  S  T  L  C
      -  P  C  F  R  C  M  L  A  A  F  T  I  T  I  G  L  A  L  C  A
      -   H  V  S  G  V  C  *  Q  H  L  Q  S  P  *  D  *  H  F  V  P
26401 - CTCCTTAACGATGTCAACACATTTAATGGCAACATTGTCAGTAAGTTTTAAATAACCAGT - 26460
      - L  L  N  D  V  N  T  F  N  G  N  I  V  S  K  F  *  I  T  S
      -  S  L  T  M  S  T  H  L  M  A  T  L  S  V  S  F  K  *  P  V
      -   P  *  R  C  Q  H  I  *  W  Q  H  C  Q  *  V  L  N  N  Q  *
26461 - AAACTGATTAACTGGTTCTTCAGGTGTAGGTTCTGGTTCTGGCTCAATCTCTGATTGCTC - 26520
      - K  L  I  N  W  F  F  R  C  R  F  W  F  W  L  N  L  *  L  L
      -  N  *  L  T  G  S  S  G  V  G  S  G  S  G  S  I  S  D  C  S
      -   T  D  *  L  V  L  Q  V  *  V  L  V  L  A  Q  S  L  I  A  Q
26521 - AGTAGTATCATCCAGCCAGTCTTCCTCTTCTTCTTCCTCAACTCGAACTGTTTCAGCTGA - 26580
      - S  S  I  I  Q  P  V  F  L  F  F  F  L  N  S  N  C  F  S  *
      -  V  V  S  S  S  Q  S  S  S  S  S  S  S  T  R  T  V  S  A  E
      -   *  Y  H  P  A  S  L  P  L  L  L  P  Q  L  E  L  F  Q  L  R
26581 - GGCACCAAATTCCAGAGGGAGACCTTGATAATCATCCTCTGTACCGTACTCATGTTCACA - 26640
      - G  T  K  F  Q  R  E  T  L  I  I  I  L  C  T  V  L  M  F  T
      -  A  P  N  S  R  G  R  P  *  *  S  S  S  V  P  Y  S  C  S  Q
      -   H  Q  I  P  E  G  D  L  D  N  H  P  L  Y  R  T  H  V  H  R
26641 - GGTTTCATCAATTTCTTCTTCCTCACACTCTGCATCGTCCTCTTCTTCCTCATCTGGAGG - 26700
      - G  F  I  N  F  F  F  L  T  L  C  I  V  L  F  F  L  I  W  R
      -  V  S  S  I  S  S  S  S  H  S  A  S  S  S  S  S  S  S  G  G
      -   F  H  Q  F  L  L  P  H  T  L  H  R  P  L  L  P  H  L  E  G
26701 - GTAAAAGGAACAATACATACGTGATGAAAAGTTTTCTTCACCAGCATCATCAAATAAGTA - 26760
      - V  K  G  T  I  H  T  *  *  K  V  F  F  T  S  I  I  K  *  V
      -  *  K  E  Q  Y  I  R  D  E  K  F  S  S  P  A  S  S  N  K  *
      -   K  R  N  N  T  Y  V  M  K  S  F  L  H  Q  H  H  Q  I  S  R
26761 - GAATGTAGCTACACTCCACTCATCAAGATCAATACCCATGTTGGTAAGGAGATCAGAAAC - 26820
      - E  C  S  Y  T  P  L  I  K  I  N  T  H  V  G  K  E  I  R  N
      -  N  V  A  T  L  H  S  S  R  S  I  P  M  L  V  R  R  S  E  T
      -   M  *  L  H  S  T  H  Q  D  Q  Y  P  C  W  *  G  D  Q  K  L
26821 - TGGTTGTAAAGTCTTCACAACAGCCTCTGCTACAACACATGCAAACTCAGTAACTTCGGT - 26880
      - W  L  *  S  L  H  N  S  L  C  Y  N  T  C  K  L  S  N  F  G
      -  G  C  K  V  F  T  T  A  S  A  T  T  H  A  N  S  V  T  S  V
      -   V  V  K  S  S  Q  Q  P  L  L  Q  H  M  Q  T  Q  *  L  R  Y
```

FIG. 12 Con't

```
26881 - ACCGGATTCAACAGTGTAGACAGAGCACTTTTCATTAAGCACTTTGTCAACACGTTCATC - 26940
       - T  G  F  N  S  V  D  R  A  L  F  I  K  H  F  V  N  T  F  I
       -  P  D  S  T  V  *  T  E  H  F  S  L  S  T  L  S  T  R  S  S
       -   R  I  Q  Q  C  R  Q  S  T  F  H  *  A  L  C  Q  H  V  H  Q
26941 - AAGCTCAAATGTGATTCTCACATTCTTGTAACCTTGAACTTCCCAAACAGTATCTTCTCC - 27000
       - K  L  K  C  D  S  H  I  L  V  T  L  N  F  P  N  S  I  F  S
       -  S  S  N  V  I  L  T  F  L  *  P  *  T  S  Q  T  V  S  S  P
       -   A  Q  M  *  F  S  H  S  C  N  L  E  L  P  K  Q  Y  L  L  Q
27001 - AAAGGTTACACCTTTAATTGGTGCACCCCCTTTTAAGCGAAAGACATTGTTTGTAGCCAG - 27060
       - K  G  Y  T  F  N  W  C  T  P  F  *  A  K  D  I  V  C  S  Q
       -  K  V  T  P  L  I  G  A  P  P  F  K  R  K  T  L  F  V  A  S
       -   R  L  H  L  *  L  V  H  P  L  L  S  E  R  H  C  L  *  P  V
27061 - TAAACCAGGAGACAATGCGCAGTATTGTTCTTTGTCCTTAATCTCTAAGAGCATGAGGCC - 27120
       - *  T  R  R  Q  C  A  V  L  F  F  V  L  N  L  *  E  H  E  A
       -  K  P  G  D  N  A  Q  Y  C  S  L  S  L  I  S  K  S  M  R  P
       -   N  Q  E  T  M  R  S  I  V  L  C  P  *  S  L  R  A  *  G  H
27121 - ATTTACACAGACTGGTGTGCCGACGATAGCTCCATTTGTGAAGCTATCAACGGGCGTCTC - 27180
       - I  Y  T  D  W  C  A  D  D  S  S  I  C  E  A  I  N  G  R  L
       -  F  T  Q  T  G  V  P  T  I  A  P  F  V  K  L  S  T  G  V  S
       -   L  H  R  L  V  C  R  R  *  L  H  L  *  S  Y  Q  R  A  S  R
27181 - GAGTGCTTCGAGTTCACCGTTCTTGAGAACAACCTCCTCAGAGGTAAGTACTGTGTCATG - 27240
       - E  C  F  E  F  T  V  L  E  N  N  L  L  R  G  K  Y  C  V  M
       -  S  A  S  S  S  P  F  L  R  T  T  S  S  E  V  S  T  V  S  C
       -   V  L  R  V  H  R  S  *  E  Q  P  P  Q  R  *  V  L  C  H  V
27241 - TGAATCACCTTCAAGAAAGGTTACTTCTTTTGGTGCCTTAAGAGGCATGAGTAGTTGCAG - 27300
       - *  I  T  F  K  K  G  Y  F  F  W  C  L  K  R  H  E  *  L  Q
       -  E  S  P  S  R  K  V  T  S  F  G  A  L  R  G  M  S  S  C  S
       -   N  H  L  Q  E  R  L  L  L  L  V  P  *  E  A  *  V  V  A  A
27301 - CTGCTCCTTGCCACGTATACACTGACGGTAAAGTCCCTTGCTTTGAGCGATGAAGACTTC - 27360
       - L  L  L  A  T  Y  T  L  T  V  K  S  L  A  L  S  D  E  D  F
       -  C  S  L  P  R  I  H  *  R  *  S  P  L  L  *  A  M  K  T  S
       -   A  P  C  H  V  Y  T  D  G  K  V  P  C  F  E  R  *  R  L  H
27361 - ACCTAAGTTGAGTGATCGCAACTTTGCGCCAGCGATAGTGACTTGATCAATGCACATTTC - 27420
       - T  *  V  E  *  S  Q  L  C  A  S  D  S  D  L  I  N  A  H  F
       -  P  K  L  S  D  R  N  F  A  P  A  I  V  T  *  S  M  H  I  S
       -   L  S  *  V  I  A  T  L  R  Q  R  *  *  L  D  Q  C  T  F  R
27421 - GAGTGCCTTGTTAACAACATCAATGAAGCATTTTACACAATCCTTGATGTTATCTGAAGC - 27480
       - E  C  L  V  N  N  I  N  E  A  F  Y  T  I  L  D  V  I  *  S
       -  S  A  L  L  T  T  S  M  K  H  F  T  Q  S  L  M  L  S  E  A
       -   V  P  C  *  Q  H  Q  *  S  I  L  H  N  P  *  C  Y  L  K  Q
27481 - AACCTGTATTTGACCCTTGACGATGTCAAAAACACCTGTAATGAGAAATTTGAGAATCTC - 27540
       - N  L  Y  L  T  L  D  D  V  K  N  T  C  N  E  K  F  E  N  L
       -  T  C  I  *  P  L  T  M  S  K  T  P  V  M  R  N  L  R  I  S
       -   P  V  F  D  P  *  R  C  Q  K  H  L  *  *  E  I  *  E  S  P
27541 - CCAAGCATCCTTGAGAAATTCAACTCCTGCACTAAGTTTCGCCTCAATCCATTCAAAGAT - 27600
       - P  S  I  L  E  K  F  N  S  C  T  K  F  R  L  N  P  F  K  D
       -  Q  A  S  L  R  N  S  T  P  A  L  S  F  A  S  I  H  S  K  I
       -   K  H  P  *  E  I  Q  L  L  H  *  V  S  P  Q  S  I  Q  R  *
27601 - AGGCCTGAGTTTTTCAACAGTAGTGCCCAAAAGATTAGACAACCACTGAGAAGTCTGTTG - 27660
       - R  P  E  F  F  N  S  S  A  Q  K  I  R  Q  P  L  R  S  L  L
       -  G  L  S  F  S  T  V  V  P  K  R  L  D  N  H  *  E  V  C  C
       -   A  *  V  F  Q  Q  *  C  P  K  D  *  T  T  T  E  K  S  V  V
27661 - TACAAGACCACCAGTTACATATGCCATAATAATGACACTGTTGGTGAGCAGGTCTGAAGT - 27720
       - Y  K  T  T  S  Y  I  C  H  N  N  D  T  V  G  E  Q  V  *  S
       -  T  R  P  P  V  T  Y  A  I  I  M  T  L  L  V  S  R  S  E  V
       -   Q  D  H  Q  L  H  M  P  *  *  *  H  C  W  *  A  G  L  K  Y
```

FIG. 12 Con't

```
27721 - ATAAACCATGGCGTCGACAAGACGTAATGACTGTTCAGAAATACCATCAAGTATGGTGAC - 27780
       - I  N  H  G  V  D  K  T  *  *  L  F  R  N  T  I  K  Y  G  D
       -  *  T  M  A  S  T  R  R  N  D  C  S  E  I  P  S  S  M  V  T
       -    K  P  W  R  R  Q  D  V  M  T  V  Q  K  Y  H  Q  V  W  *  Q
27781 - AGCTGCTCTTTGCAAATCAGGAATTGAGTGGTTTGCTGCATCAAGTGTGCGCGCAAAAAT - 27840
       - S  C  S  L  Q  I  R  N  *  V  V  C  C  I  K  C  A  R  K  N
       -  A  A  L  C  K  S  G  I  E  W  F  A  A  S  S  V  R  A  K  I
       -    L  L  F  A  N  Q  E  L  S  G  L  L  H  Q  V  C  A  Q  K  L
27841 - TGATCTGATAACACCAGCAGCCTGTGAGGGAAAACCACACAGTGGTGTTAAAACTGATCT - 27900
       - *  S  D  N  T  S  S  L  *  G  K  T  T  Q  W  C  *  N  *  S
       -  D  L  I  T  P  A  A  C  E  G  K  P  H  S  G  V  K  T  D  L
       -    I  *  *  H  Q  Q  P  V  R  E  N  H  T  V  V  L  K  L  I  S
27901 - CTGTTGTCCAATGTTCCAAGCACCTTTTACGGGCTTTCCCTTGGTAACTTTATAGTTACC - 27960
       - L  L  S  N  V  P  S  T  F  Y  G  L  S  L  G  N  F  I  V  T
       -  C  C  P  M  F  Q  A  P  F  T  G  F  P  L  V  T  L  *  L  P
       -    V  V  Q  C  S  K  H  L  L  R  A  F  P  W  *  L  Y  S  Y  R
27961 - GCAGGACTCAACAATGGTTTTGAAAGACTTGTAATCAAGACTCTTTATAGTGTCAATAAA - 28020
       - A  G  L  N  N  G  F  E  R  L  V  I  K  T  L  Y  S  V  N  K
       -  Q  D  S  T  M  V  L  K  D  L  *  S  R  L  F  I  V  S  I  K
       -    R  T  Q  Q  W  F  *  K  T  C  N  Q  D  S  L  *  C  Q  *  R
28021 - GGCACTTGTAGAAGCAGAGAAAGATGCCAAAATGATGGCAACCTCTTCATTCAAATGAAA - 28080
       - G  T  C  R  S  R  E  R  C  Q  N  D  G  N  L  F  I  Q  M  K
       -  A  L  V  E  A  E  K  D  A  K  M  M  A  T  S  S  F  K  *  K
       -    H  L  *  K  Q  R  K  M  P  K  *  W  Q  P  L  H  S  N  E  N
28081 - ATCGCCAACAATGTTAATGTTAACACGTTCACGACTCAGTATCTCAAGGAGATCCTCATT - 28140
       - I  A  N  N  V  N  V  N  T  F  T  T  Q  Y  L  K  E  I  L  I
       -  S  P  T  M  L  M  L  T  R  S  R  L  S  I  S  R  R  S  S  F
       -    R  Q  Q  C  *  C  *  H  V  H  D  S  V  S  Q  G  D  P  H  S
28141 - CAAGGTCTCCACATTGTCACCAGTAATGCCAGTATGGCCTGAGCCAATATCAGCACTAGC - 28200
       - Q  G  L  H  I  V  T  S  N  A  S  M  A  *  A  N  I  S  T  S
       -  K  V  S  T  L  S  P  V  M  P  V  W  P  E  P  I  S  A  L  A
       -    R  S  P  H  C  H  Q  *  C  Q  Y  G  L  S  Q  Y  Q  H  *  H
28201 - ACGAGGAACCCAGTAGGCACGCTTATTATAGCAGCCAACATAGGCAAACACACAGCCTCC - 28260
       - T  R  N  P  V  G  T  L  I  I  A  A  N  I  G  K  H  T  A  S
       -  R  G  T  Q  *  A  R  L  L  *  Q  P  T  *  A  N  T  Q  P  P
       -    E  E  P  S  R  H  A  Y  Y  S  S  Q  H  R  Q  T  H  S  L  Q
28261 - AAAACATCTAGTCCTACCTCCCTTGCGGAGTCGAGTTTCAATGTTTGAGTGGTTGTGATA - 28320
       - K  T  S  S  P  T  S  L  A  E  S  S  F  N  V  *  V  V  V  I
       -  K  H  L  V  L  P  P  L  R  S  R  V  S  M  F  E  W  L  *  *
       -    N  I  *  S  Y  L  P  C  G  V  E  F  Q  C  L  S  G  C  D  N
28321 - ATCTGCAACACTATGCTCAGGTCCAATCTCTGGGTCTTGACAGGCAGGACATGGCATTTT - 28380
       - I  C  N  T  M  L  R  S  N  L  W  V  L  T  G  R  T  W  H  F
       -  S  A  T  L  C  S  G  P  I  S  G  S  *  Q  A  G  H  G  I  F
       -    L  Q  H  Y  A  Q  V  Q  S  L  G  L  D  R  Q  D  M  A  F  S
28381 - CACTACAGCATTAGTAGGTAGGTACCCACATGTAGTAGGTCCTTCAATAACTAAATTTTC - 28440
       - H  Y  S  I  S  R  *  V  P  T  C  S  R  S  F  N  N  *  I  F
       -  T  T  A  L  V  G  R  Y  P  H  V  V  G  P  S  I  T  K  F  S
       -    L  Q  H  *  *  V  G  T  H  M  *  *  V  L  Q  *  L  N  F  Q
28441 - AGTGCCACAATGTTCACAAGTGGCTTTCAGAAAGTCGCACGTCTGCCATGAAACTTCATC - 28500
       - S  A  T  M  F  T  S  G  F  Q  K  V  A  R  L  P  *  N  F  I
       -  V  P  Q  C  S  Q  V  A  F  R  K  S  H  V  C  H  E  T  S  S
       -    C  H  N  V  H  K  W  L  S  E  S  R  T  S  A  M  K  L  H  R
28501 - GCAATGATTACATTTCATCAAGGTAGACAAGTGCATATTGTTACACTCCTGTGGAGATGC - 28560
       - A  M  I  T  F  H  Q  G  R  Q  V  H  I  V  T  L  L  W  R  C
       -  Q  *  L  H  F  I  K  V  D  K  C  I  L  L  H  S  C  G  D  A
       -    N  D  Y  I  S  S  R  *  T  S  A  Y  C  Y  T  P  V  E  M  Q
```

FIG. 12 Con't

```
28561 - AACAGGGTACACAGAGCGTATACGCCCCATGAAACCCTCAGTCTTTTTCTTTTCAACACG - 28620
      - N  R  V  H  R  A  Y  T  P  H  E  T  L  S  L  F  L  F  N  T
      -  T  G  Y  T  E  R  I  R  P  M  K  P  S  V  F  F  S  T  R
      -   Q  G  T  Q  S  V  Y  A  P  *  N  P  Q  S  F  S  F  Q  H  V
28621 - TGGTTGAATGACTTTGACTTTTGAGTTAAGAGGAAACACAAACTTTGGGCATTCCCCTTT - 28680
      - W  L  N  D  F  D  F  *  V  K  R  K  H  K  L  W  A  F  P  F
      -  G  *  M  T  L  T  F  E  L  R  G  N  T  N  F  G  H  S  P  L
      -   V  E  *  L  *  L  L  S  *  E  E  T  Q  T  L  G  I  P  L  *
28681 - GAAAGTGTCAAATTTCTTGGCACTCTTAATTTCGAAGGGTGTCTGGTGCTCGTAGCTCTT - 28740
      - E  S  V  K  F  L  G  T  L  N  F  E  G  C  L  V  L  V  A  L
      -  K  V  S  N  F  L  A  L  L  I  S  K  G  V  W  C  S  *  L  L
      -   K  C  Q  I  S  W  H  S  *  F  R  R  V  S  G  A  R  S  S  Y
28741 - ATCAGAGCGCTCAGTGAACCAGGCAATTTCATGCTCATGGTCACGGCAGCAGTAGACACC - 28800
      - I  R  A  L  S  E  P  G  N  F  M  L  M  V  T  A  A  V  D  T
      -  S  E  R  S  V  N  Q  A  I  S  C  S  W  S  R  Q  Q  *  T  P
      -   Q  S  A  Q  *  T  R  Q  F  H  A  H  G  H  G  S  S  R  H  L
28801 - TCTCTTCGACTCGATGTAATCAAGTTGTTCGGAAAGAGTGCACATTGACTTGCCCGCGCG - 28860
      - S  L  R  L  D  V  I  K  L  F  G  K  S  A  H  *  L  A  R  A
      -  L  F  D  S  M  *  S  S  C  S  E  R  V  H  I  D  L  P  A  R
      -   S  S  T  R  C  N  Q  V  V  R  K  E  C  T  L  T  C  P  R  V
28861 - TGCGAGAAAATCTTTGATGCAATCAAGAGGGTACCCATCTGGGCCACAGAAATTGTTGTC - 28920
      - C  E  K  I  F  D  A  I  K  R  V  P  I  W  A  T  E  I  V  V
      -  A  R  K  S  L  M  Q  S  R  G  Y  P  S  G  P  Q  K  L  L  S
      -   R  E  N  L  *  C  N  Q  E  G  T  H  L  G  H  R  N  C  C  R
28921 - GACATAGCGAGTGACTGCACCTCCATTGAGCTCACGAGTGAGTTCACGGAGTGCACCACT - 28980
      - D  I  A  S  D  C  T  S  I  E  L  T  S  E  F  T  E  C  T  T
      -  T  *  R  V  T  A  P  P  L  S  S  R  V  S  S  R  S  A  P  L
      -   H  S  E  *  L  H  L  H  *  A  H  E  *  V  H  G  V  H  H  C
28981 - GCCATGCTTAGTGTTCCAGTTTTGTTCATAATCTTCAATGGGATCAGTGCCAAGCTCGTC - 29040
      - A  M  L  S  V  P  V  L  F  I  I  F  N  G  I  S  A  K  L  V
      -  P  C  L  V  F  Q  F  C  S  *  S  S  M  G  S  V  P  S  S  S
      -   H  A  *  C  S  S  F  V  H  N  L  Q  W  D  Q  C  Q  A  R  H
29041 - ACCTAAGTCATAAGACTTTAGATCGATGCCATAGCTATGACCACCGGCTCCCTTATTACC - 29100
      - T  *  V  I  R  L  *  I  D  A  I  A  M  T  T  G  S  L  I  T
      -  P  K  S  *  D  F  R  S  M  P  *  L  *  P  P  A  P  L  L  P
      -   L  S  H  K  T  L  D  R  C  H  S  Y  D  H  R  L  P  Y  Y  R
29101 - GTTCTTACGAAGAAGAACATTGCGGTATGCAATTGGGGTTTCGCCCACATGTGGCACGAG - 29160
      - V  L  T  K  K  N  I  A  V  C  N  W  G  F  A  H  M  W  H  E
      -  F  L  R  R  R  T  L  R  Y  A  I  G  V  S  P  T  C  G  T  S
      -   S  Y  E  E  E  H  C  G  M  Q  L  G  F  R  P  H  V  A  R  V
29161 - TACTCCCAGTGTTATACCGCTACGACCGTACTGAATGCCGTCCATTTCTGCAACCAGCTC - 29220
      - Y  S  Q  C  Y  T  A  T  T  V  L  N  A  V  H  F  C  N  Q  L
      -  T  P  S  V  I  P  L  R  P  Y  *  M  P  S  I  S  A  T  S  S
      -   L  P  V  L  Y  R  Y  D  R  T  E  C  R  P  F  L  Q  P  A  Q
29221 - AACGACCTTGTGGCCGTGATTGGTGCTTAAGGCATCAGAACGTTTAATGAACACATAGGG - 29280
      - N  D  L  V  A  V  I  G  A  *  G  I  R  T  F  N  E  H  I  G
      -  T  T  L  W  P  *  L  V  L  K  A  S  E  R  L  M  N  T  *  G
      -   R  P  C  G  R  D  W  C  L  R  H  Q  N  V  *  *  T  H  R  A
29281 - CTGTTCAAGCTGGGCAGTACGCCTTTTTCCAGCTCTACTAGACCACAAGTGCCATTTTT - 29340
      - L  F  K  L  G  Q  Y  A  F  F  Q  L  Y  *  T  T  S  A  I  F
      -  C  S  S  W  G  S  T  P  F  S  S  S  T  R  P  Q  V  P  F  L
      -   V  Q  A  G  A  V  R  L  F  P  A  L  L  D  H  K  C  H  F  *
29341 - GAGGTGTTCACGTGCCTCCGATAGGGCCTCTTCCACAGAGTCCCCGAAGCCACGCACTAG - 29400
      - E  V  F  T  C  L  R  *  G  L  F  H  R  V  P  E  A  T  H  *
      -  R  C  S  R  A  S  D  R  A  S  S  T  E  S  P  K  P  R  T  S
      -   G  V  H  V  P  P  I  G  P  L  P  Q  S  P  R  S  H  A  L  A
```

FIG. 12 Con't

```
29401 - CACGTCTCTAACCTGAAGGACAGGCAAACTGAGTTGGACGTGTGTTTTCTCGTTGACACC - 29460
      - H   V   S   N   L   K   D   R   Q   T   E   L   D   V   C   F   L   V   D   T
      -   T   S   L   T   *   R   T   G   K   L   S   W   T   C   V   F   S   L   T   P
      -     R   L   *   P   E   G   Q   A   N   *   V   G   R   V   F   S   R   *   H   Q
29461 - AAGAACAAGGCTCTCCATCTTACCTTTCGGTCACACCCGGACGAAACCTAGGTATGCTGA - 29520
      - K   N   K   A   L   H   L   T   F   R   S   H   P   D   E   T   *   V   C   *
      -   R   T   R   L   S   I   L   P   F   G   H   T   R   T   K   P   R   Y   A   D
      -     E   Q   G   S   P   S   Y   L   S   V   T   P   G   R   N   L   G   M   L   M
29521 - TGATCGACTGCAACACGGACGAAACCGTAAGCAGTCTGCAGAAGAGGGACGAGTTACTCG - 29580
      - *   S   T   A   T   R   T   K   P   *   A   V   C   R   R   G   T   S   Y   S
      -   D   R   L   Q   H   G   R   N   R   K   Q   S   A   E   E   G   R   V   T   R
      -     I   D   C   N   T   D   E   T   V   S   S   L   Q   K   R   D   E   L   L   V
29581 - TTTCTTGTCAACGACAGTAAAATTTATTATTGTTTATACTGCGTAGGTGCACTAGGCATG - 29640
      - F   L   V   N   D   S   K   I   Y   Y   C   L   Y   C   V   G   A   L   G   M
      -   F   L   S   T   T   V   K   F   I   I   V   Y   T   A   *   V   H   *   A   C
      -     S   C   Q   R   Q   *   N   L   L   F   I   L   R   R   C   T   R   H   A
29641 - CAGCCGAGCGACAGCTACACAGATTTTAAAGTTCGTTTAGAGAACAGATCTACAAGAGAT - 29700
      - Q   P   S   D   S   Y   T   D   F   K   V   R   L   E   N   R   S   T   R   D
      -   S   R   A   T   A   T   Q   I   L   K   F   V   *   R   T   D   L   Q   E   I
      -     A   E   R   Q   L   H   R   F   *   S   S   F   R   E   Q   I   Y   K   R   S
29701 - CGAGGTTGGTTGGCTTTTCCTGGGTAGGTAAAAACCTAATAT - 29742
      - R   G   W   L   A   F   P   G   *   V   K   T   *   Y   X
      -   E   V   G   W   L   F   L   G   R   *   K   P   N   X
      -     R   L   V   G   F   S   W   V   G   K   N   L   I   X
```

FIG. 12 Con't

N-gene primers (nucleotide position 29247-29410)
  150# (5'-gactgatgaagctcaggcctt-3')
  200# (5'-cttgtgtggtcatcatgagtg-3')

S-gene primers (nucleotide position 24751-25049)
  131# (5'-cacagaggaacttctttt-3')
  132# (5'-tcccaattcttgaaggtcaatgag-3')

FIG. 13

```
ATGTCTGATAATGGACCCCAATCAAACCAACGTAGTGCCCCCCGCATTACATTTGGTGGA
CCCACAGATTCAACTGACAATAACCAGAATGGAGGACGCAATGGGGCAAGGCCAAAACAG
CGCCGACCCCAAGGTTTACCCAATAATACTGCGTCTTGGTTCACAGCTCTCACTCAGCAT
GGCAAGGAGGAACTTAGATTCCCTCGAGGCCAGGGCGTTCCAATCAACACCAATAGTGGT
CCAGATGACCAAATTGGCTACTACCGAAGAGCTACCCGACGAGTTCGTGGTGGTGACGGC
AAAATGAAAGAGCTCAGCCCCAGATGGTACTTCTATTACCTAGGAACTGGCCCAGAAGCT
TCACTTCCCTACGGCGCTAACAAAGAAGGCATCGTATGGGTTGCAACTGAGGGAGCCTTG
AATACACCCAAAGACCACATTGGCACCCGCAATCCTAATAACAATGCTGCCACCGTGCTA
CAACTTCCTCAAGGAACAACATTGCCAAAAGGCTTCTACGCAGAGGGAAGCAGAGGCGGC
AGTCAAGCCTCTTCTCGCTCCTCATCACGTAGTCGCGGTAATTCAAGAAATTCAACTCCT
GGCAGCAGTAGGGGAAATTCTCCTGCTCGAATGGCTAGCGGAGGTGGTGAAACTGCCCTC
GCGCTATTGCTGCTAGACAGATTGAACCAGCTTGAGAGCAAAGTTTCTGGTAAAGGCCAA
CAACAACAAGGCCAAACTGTCACTAAGAAATCTGCTGCTGAGGCATCTAAAAAGCCTCGC
CAAAAACGTACTGCCACAAAACAGTACAACGTCACTCAAGCATTTGGGAGACGTGGTCCA
GAACAAACCCAAGGAAATTTCGGGGACCAAGACCTAATCAGACAAGGAACTGATTACAAA
CATTGGCCGCAAATTGCACAATTTGCTCCAAGTGCCTCTGCATTCTTTGGAATGTCACGC
ATTGGCATGGAAGTCACACCTTCGGGAACATGGCTGACTTATCATGGAGCCATTAAATTG
GATGACAAAGATCCACAATTCAAAGACAACGTCATACTGCTGAACAAGCACATTGACGCA
TACAAAACATTCCCACCAACAGAGCCTAAAAAGGACAAAAGAAAAAGACTGATGAAGCT
CAGCCTTTGCCGCAGAGACAAAAGAAGCAGCCCACTGTGACTCTTCTTCCTGCGGCTGAC
ATGGATGATTTCTCCAGACAACTTCAAAATTCCATGAGTGGAGCTTCTGCTGATTCAACT
CAGGCATAA
```

FIG. 14A

MSDNGPQSNQRSAPRITFGGPTDSTDNNQNGGRNGARPKQRRPQGLPNNTASWFTALTQH
GKEELRFPRGQGVPINTNSGPDDQIGYYRRATRRVRGGDGKMKELSPRWYFYYLGTGPEA
SLPYGANKEGIVWVATEGALNTPKDHIGTRNPNNNAATVLQLPQGTTLPKGFYAEGSRGG
SQASSRSSSRSRGNSRNSTPGSSRGNSPARMASGGGETALALLLLDRLNQLESKVSGKGQ
QQQGQTVTKKSAAEASKKPRQKRTATKQYNVTQAFGRRGPEQTQGNFGDQDLIRQGTDYK
HWPQIAQFAPSASAFFGMSRIGMEVTPSGTWLTYHGAIKLDDKDPQFKDNVILLNKHIDA
YKTFPPTEPKKDKKKKTDEAQPLPQRQKKQPTVTLLPAADMDDFSRQLQNSMSGASADST
QA

FIG. 14B

```
ATGTTTATTTTCTTATTATTTCTTACTCTCACTAGTGGTAGTGACCTTGACCGGTGCACCACTTT
TGATGATGTTCAAGCTCCTAATTACACTCAACATACTTCATCTATGAGGGGGGTTTACTATCCTG
ATGAAATTTTTAGATCAGACACTCTTTATTTAACTCAGGATTTATTTCTTCCATTTTATTCTAAT
GTTACAGGGTTTCATACTATTAATCATACGTTTGGCAACCCTGTCATACCTTTTAAGGATGGTAT
TTATTTTGCTGCCACAGAGAAATCAAATGTTGTCCGTGGTTGGGTTTTTGGTTCTACCATGAACA
ACAAGTCACAGTCGGTGATTATTATTAACAATTCTACTAATGTTGTTATACGAGCATGTAACTTT
GAATTGTGTGACAACCCTTTCTTTGCTGTTTCTAAACCCATGGGTACACAGACACATACTATGAT
ATTCGATAATGCATTTAATTGCACTTTCGAGTACATATCTGATGCCTTTTCGCTTGATGTTTCAG
AAAAGTCAGGTAATTTTAAACACTTACGAGAGTTTGTGTTTAAAAATAAAGATGGGTTTCTCTAT
GTTTATAAGGGCTATCAACCTATAGATGTAGTTCGTGATCTACCTTCTGGTTTTAACACTTTGAA
ACCTATTTTAAGTTGCCTCTTGGTATTAACATTACAAATTTTAGAGCCATTCTTACAGCCTTTT
CACCTGCTCAAGACATTTGGGGCACGTCAGCTGCAGCCTATTTTGTTGGCTATTTAAAGCCAACT
ACATTTATGCTCAAGTATGATGAAAATGGTACAATCACAGATGCTGTTGATTGTTCTCAAAATCC
ACTTGCTGAACTCAAATGCTCTGTTAAGAGCTTTGAGATTGACAAAGGAATTTACCAGACCTCTA
ATTTCAGGGTTGTTCCCTCAGGAGATGTTGTGAGATTCCCTAATATTACAAACTTGTGTCCTTTT
GGAGAGGTTTTTAATGCTACTAAATTCCCTTCTGTCTATGCATGGGAGAGAAAAAAATTTCTAA
TTGTGTTGCTGATTACTCTGTGCTCTACAACTCAACATTTTTTCAACCTTTAAGTGCTATGGCG
TTTCTGCCACTAAGTTGAATGATCTTTGCTTCTCCAATGTCTATGCAGATTCTTTTGTAGTCAAG
GGAGATGATGTAAGACAAATAGCGCCAGGACAAACTGGTGTTATTGCTGATTATAATTATAAATT
GCCAGATGATTTCATGGGTTGTGTCCTTGCTTGGAATACTAGGAACATTGATGCTACTTCAACTG
GTAATTATAATTATAAATATAGGTATCTTAGACATGGCAAGCTTAGGCCCTTTGAGAGAGACATA
TCTAATGTGCCTTTCTCCCCTGATGGCAAACCTTGCACCCCACCTGCTCTTAATTGTTATTGGCC
ATTAAATGATTATGGTTTTTACACCACTACTGGCATTGGCTACCAACCTTACAGAGTTGTAGTAC
TTTCTTTTGAACTTTTAAATGCACCGGCCACGGTTTGTGGACCAAAATTATCCACTGACCTTATT
AAGAACCAGTGTGTCAATTTTAATTTTAATGGACTCACTGGTACTGGTGTGTTAACTCCTTCTTC
AAAGAGATTTCAACCATTTCAACAATTTGGCCGTGATGTTTCTGATTTCACTGATTCCGTTCGAG
ATCCTAAAACATCTGAAATATTAGACATTTCACCTTGCTCTTTTGGGGGTGTAAGTGTAATTACA
CCTGGAACAAATGCTTCATCTGAAGTTGCTGTTCTATATCAAGATGTTAACTGCACTGATGTTTC
TACAGCAATTCATGCAGATCAACTCACACCAGCTTGGCGCATATATTCTACTGGAAACAATGTAT
```

FIG. 15A

```
TCCAGACTCAAGCAGGCTGTCTTATAGGAGCTGAGCATGTCGACACTTCTTATGAGTGCGACATT
CCTATTGGAGCTGGCATTTGTGCTAGTTACCATACAGTTTCTTTATTACGTAGTACTAGCCAAAA
ATCTATTGTGGCTTATACTATGTCTTTAGGTGCTGATAGTTCAATTGCTTACTCTAATAACACCA
TTGCTATACCTACTAACTTTTCAATTAGCATTACTACAGAAGTAATGCCTGTTTCTATGGCTAAA
ACCTCCGTAGATTGTAATATGTACATCTGCGGAGATTCTACTGAATGTGCTAATTTGCTTCTCCA
ATATGGTAGCTTTTGCACACAACTAAATCGTGCACTCTCAGGTATTGCTGCTGAACAGGATCGCA
ACACACGTGAAGTGTTCGCTCAAGTCAAACAAATGTACAAAACCCCAACTTTGAAATATTTTGGT
GGTTTTAATTTTTCACAAATATTACCTGACCCTCTAAAGCCAACTAAGAGGTCTTTTATTGAGGA
CTTGCTCTTTAATAAGGTGACACTCGCTGATGCTGGCTTCATGAAGCAATATGGCGAATGCCTAG
GTGATATTAATGCTAGAGATCTCATTTGTGCGCAGAAGTTCAATGGACTTACAGTGTTGCCACCT
CTGCTCACTGATGATATGATTGCTGCCTACACTGCTGCTCTAGTTAGTGGTACTGCCACTGCTGG
ATGGACATTTGGTGCTGGCGCTGCTCTTCAAATACCTTTTGCTATGCAAATGGCATATAGGTTCA
ATGGCATTGGAGTTACCCAAAATGTTCTCTATGAGAACCAAAAACAAATCGCCAACCAATTTAAC
AAGGCGATTAGTCAAATTCAAGAATCACTTACAACAACATCAACTGCATTGGGCAAGCTGCAAGA
CGTTGTTAACCAGAATGCTCAAGCATTAAACACACTTGTTAAACAACTTAGCTCTAATTTTGGTG
CAATTTCAAGTGTGCTAAATGATATCCTTTCGCGACTTGATAAAGTCGAGGCGGAGGTACAAATT
GACAGGTTAATTACAGGCAGACTTCAAAGCCTTCAAACCTATGTAACACAACAACTAATCAGGGC
TGCTGAAATCAGGGCTTCTGCTAATCTTGCTGCTACTAAAATGTCTGAGTGTGTTCTTGGACAAT
CAAAAAGAGTTGACTTTTGTGGAAAGGGCTACCACCTTATGTCCTTCCCACAAGCAGCCCCGCAT
GGTGTTGTCTTCCTACATGTCACGTATGTGCCATCCCAGGAGAGGAACTTCACCACAGCGCCAGC
AATTTGTCATGAAGGCAAAGCATACTTCCCTCGTGAAGGTGTTTTTGTGTTTAATGGCACTTCTT
GGTTTATTACACAGAGGAACTTCTTTTCTCCACAAATAATTACTACAGACAATACATTTGTCTCA
GGAAATTGTGATGTCGTTATTGGCATCATTAACAACACAGTTTATGATCCTCTGCAACCTGAGCT
TGACTCATTCAAAGAAGAGCTGGACAAGTACTTCAAAAATCATACATCACCAGATGTTGATCTTG
GCGACATTTCAGGCATTAACGCTTCTGTCGTCAACATTCAAAAAGAAATTGACCGCCTCAATGAG
GTCGCTAAAAATTTAAATGAATCACTCATTGACCTTCAAGAATTGGGAAAATATGAGCAATATAT
TAAATGGCCTTGGTATGTTTGGCTCGGCTTCATTGCTGGACTAATTGCCATCGTCATGGTTACAA
TCTTGCTTTGTTGCATGACTAGTTGTTGCAGTTGCCTCAAGGGTGCATGCTCTTGTGGTTCTTGC
TGCAAGTTTGATGAGGATGACTCTGAGCCAGTTCTCAAGGGTGTCAAATTACATTACACATAA
```

FIG. 15A Con't

```
MFIFLLFLTLTSGSDLDRCTTFDDVQAPNYTQHTSSMRGVYYPDEIFRSDTLYLTQDLFL
PFYSNVTGFHTINHTFGNPVIPFKDGIYFAATEKSNVVRGWVFGSTMNNKSQSVIIINNS
TNVVIRACNFELCDNPFFAVSKPMGTQTHTMIFDNAFNCTFEYISDAFSLDVSEKSGNFK
HLREFVFKNKDGFLYVYKGYQPIDVVRDLPSGFNTLKPIFKLPLGINITNFRAILTAFSP
AQDIWGTSAAAYFVGYLKPTTFMLKYDENGTITDAVDCSQNPLAELKCSVKSFEIDKGIY
QTSNFRVVPSGDVVRFPNITNLCPFGEVFNATKFPSVYAWERKKISNCVADYSVLYNSTF
FSTFKCYGVSATKLNDLCFSNVYADSFVVKGDDVRQIAPGQTGVIADYNYKLPDDFMGCV
LAWNTRNIDATSTGNYNYKYRYLRHGKLRPFERDISNVPFSPDGKPCTPPALNCYWPLND
YGFYTTTGIGYQPYRVVVLSFELLNAPATVCGPKLSTDLIKNQCVNFNFNGLTGTGVLTP
SSKRFQPFQQFGRDVSDFTDSVRDPKTSEILDISPCSFGGVSVITPGTNASSEVAVLYQD
VNCTDVSTAIHADQLTPAWRIYSTGNNVFQTQAGCLIGAEHVDTSYECDIPIGAGICASY
HTVSLLRSTSQKSIVAYTMSLGADSSIAYSNNTIAIPTNFSISITTEVMPVSMAKTSVDC
NMYICGDSTECANLLLQYGSFCTQLNRALSGIAAEQDRNTREVFAQVKQMYKTPTLKYFG
GFNFSQILPDPLKPTKRSFIEDLLFNKVTLADAGFMKQYGECLGDINARDLICAQKFNGL
TVLPPLLTDDMIAAYTAALVSGTATAGWTFGAGAALQIPFAMQMAYRFNGIGVTQNVLYE
NQKQIANQFNKAISQIQESLTTTSTALGKLQDVVNQNAQALNTLVKQLSSNFGAISSVLN
DILSRLDKVEAEVQIDRLITGRLQSLQTYVTQQLIRAAEIRASANLAATKMSECVLGQSK
RVDFCGKGYHLMSFPQAAPHGVVFLHVTYVPSQERNFTTAPAICHEGKAYFPREGVFVFN
GTSWFITQRNFFSPQIITTDNTFVSGNCDVVIGIINNTVYDPLQPELDSFKEELDKYFKN
HTSPDVDLGDISGINASVVNIQKEIDRLNEVAKNLNESLIDLQELGKYEQYIKWPWYVWL
GFIAGLIAIVMVTILLCCMTSCCSCLKGACSCGSCCKFDEDDSEPVLKGVKLHYT
```

FIG. 15B

- Primers for a 225-bp fragment of the region of N-gene that showed no homology to other coronavirus:

SRS251: 5'-GCAGTCAAGCCTCTTCTCG-3' (SEQ ID NO:2480)

SRS252: 5'-GCCTCAGCAGCAGATTTC-3' (SEQ ID NO:2481)

- Primers for 181-bp fragment of the region of 1b-gene:

coro3: 5'-TACACACCTCAGCGTTG-3' (SEQ ID NO:3)

coro4: 5'- CACGAACGTGACGAAT-3' (SEQ ID NO:4)

- Primers for a 745-bp fragment from pig β-actin gene:

Actin-F: 5'-TGAGACCTTCAACACGCC-3' (SEQ ID NO:2482)

Actin-R: 5'-ATCTGCTGGAAGGTGGAC-3'(SEQ ID NO:2483)

FIG. 20

| Probe | Region | SEQ ID NO | Sequence |
|---|---|---|---|
| 1b | 18057–18222 | 2484 | gatataaaattcaagactgaaggattatgtgttgacataccaggcataccaaggacat gacctaccgtagactcatctctatgatgggtttcaaaatgaattaccaagtcaatggttac cctaatatgttatcaccccgcgaagaagctattcgttcacgttcgtg |
| S | 21920–22107 | 2485 | catgggtacacagacacatactatgtatattcgataatgcattaattgcactttcgagtaca tatctgatgcctttcgttttcgcttgatgttcagaaaagtcagtaatttaaacacttacgagagt ttgtgtttaaaataaagatggggtttctctatgttataagggctatcaacctatagatgtag |
| M | 26867–26996 | 2486 | gctgtgacattaaggacctgccaaaagagatcactgtgctacatcacgaacgctttctt attacaaattaggagcgtcgcagcgttgaggcactgattcaggttttgctgcatacaacc gctaccgtat |
| N | 28658–28883 | 2487 | gcagtcaagcctcttctgctcctcatcacgtagtcgcggtaattcaagaaattcaactc ctggcagtaggggaaattctcctgctcgaatggctagcggaggtggtgaaactgc cctcgcgctattgctgctagacagattg |

FIG. 25

US 7,547,512 B2

HIGH-THROUGHPUT DIAGNOSTIC ASSAY FOR THE HUMAN VIRUS CAUSING SEVERE ACUTE RESPIRATORY SYNDROME (SARS)

This application claims priority benefit to U.S. provisional application No. 60/457,031, filed Mar. 24, 2003; U.S. provisional application No. 60/457,730, filed Mar. 26, 2003; U.S. provisional application No. 60/459,931, filed Apr. 2, 2003; U.S. provisional application No. 60/460,357, filed Apr. 3, 2003; U.S. provisional application No. 60/461,265, filed Apr. 8, 2003; U.S. provisional application No. 60/462,805, filed Apr. 14, 2003; U.S. provisional application No. 60/464,886 filed Apr. 23, 2003, U.S. provisional application No. 60/465,738, filed Apr. 25, 2003; and U.S. provisional application No. 60/470,935, filed May 14, 2003, each of which is incorporated herein by reference in its entirety.

The instant application contains a lengthy Sequence listing which is being concurrently submitted via triplicate CD-R in lieu of a printed paper copy, and is hereby inconrporated by reference in its entirety. Said CD-R, recorded on Mar. 22, 2004, are labeled "CRF", "Copy 1" and "Copy 2", respectively, and each contains only identical 1.6 MB file (V9661077.APP).

1. INTRODUCTION

The present invention relates to a high-throughput diagnostic assay for the virus causing Severe Acute Respiratory Syndrome (SARS) in humans ("hSARS virus"). In particular, the invention relates to a high-throughput reverse transcription-PCR diagnostic test for SARS associated *coronavirus* (SARS-CoV). The present assay is a rapid, reliable assay which may be used for diagnosis and monitoring the spread of SARS. The present method eliminates false negative results and provides increased sensitivity for the assay. The invention further relates to nucleotide sequences and portions thereof, useful for the diagnosis of SARS. The invention further relates to nucleotide sequences and portions thereof, useful for assessing genetic diversity of SARS. The nucleotide sequences of the present invention comprise the (Nucleocapsid) N-gene and the S-gene sequences of the hSARS virus. The invention relates to a diagnostic kit that comprises nucleic acid molecules for the detection of the N-gene or S-gene of hSARS virus. The invention also relates to the deduced amino acid sequences of the N-gene and S-gene products of the hSARS virus. The invention further relates to the use of the N-gene and S-gene products in diagnostic methods. The invention further encompasses diagnostic assays and kits comprising antibodies generated against the N-gene or S-gene product.

2. BACKGROUND OF THE INVENTION

Recently, there has been an outbreak of atypical pneumonia in Guangdong province in mainland China. Between November 2002 and March 2003, there were 792 reported cases with 31 fatalities (WHO. Severe Acute Respiratory Syndrome (SARS) *Weekly Epidemiol Rec.* 2003; 78: 86). Patients with SARS show various clinical symptoms, including fever (of 38 degrees Celsius or above for over 24 hours), malaise, chills, headache and body ache. Chest X-rays show changes compatible with pneumonia. Other symptoms include coughing, shortness of breath or difficulty in breathing. By 3 May 2003, a cumulative total number of 1621 cases and 179 deaths had been occurred in Hong Kong, which contributed to 26% and 41% of the global reported cases (6234) and deaths (435) respectively. As the disease is highly contagious and spreads in daily-life activities, it is important to develop a rapid and reliable diagnosis test to monitor and control the disease. In response to this crisis, the Hospital Authority in Hong Kong has increased the surveillance on patients with severe atypical pneumonia. In the course of this investigation, a number of clusters of health care workers with the disease were identified. In addition, there were clusters of pneumonia incidents among persons in close contact with those infected. The disease was unusual in its severity and its progression in spite of the antibiotic treatment typical for the bacterial pathogens that are known to be commonly associated with atypical pneumonia. The present inventors were one of the groups involved in the investigation of these patients. All tests for identifying commonly recognized viruses and bacteria were negative in these patients. Furthermore, diagnostic tests for the detection of other genes in the hSARS virus, such as the 1b-gene are not useful to accurately diagnose SARS. The disease was given the acronym Severe Acute Respiratory Syndrome ("SARS"). This virus mutates and changes rapidly and hence the diagnostic of SARS was extremely difficult until the isolation of particular regions of the virus, the N-gene and S-gene, of the hSARS virus from the SARS patients by the present inventors as disclosed herein. Namely, the present invention discloses a diagnostic assay using particular regions in the genome of the virus for rapid, accurate, reliable and specific identification of the hSARS virus. The invention is useful in both clinical and scientific research applications. Furthermore, the present invention provides a high-throughput assay which can be used as a sensitive method for diagnosis and monitoring the spread of the SARS.

3. SUMMARY OF INVENTION

The present invention is based upon the inventors' identification of a specific region of the hSARS virus, specifically, the 3'region of the hSARS viral genome, and in particular, the (nucleocapsid) N-gene of the hSARS virus that may be used in diagnostic assay to detect hSARS. In particular, the N-gene is useful for the diagnosis of SARS because the N-gene has the most abundant copy number during viral infection compared to any other gene in the hSARS virus, especially when the cells are lysed. Thus, the nucleic acid sequences of the N-gene of the hSARS virus are particularly useful in a rapid and reliable diagnostic assay for the hSARS virus. Furthermore, the present method eliminates false negative results and increases the sensitivity of the assay.

The hSARS virus was isolated from patients suffering from SARS in the recent outbreak of severe atypical pneumonia in China. The isolated virus is an enveloped, single-stranded RNA virus of positive polarity which belongs to the order, Nidovirales, of the family, Coronaviridae. The hSARS virus is a very large RNA virus consisting of approximately 29,742 nucleotides. The complete genomic sequence of the hSARS virus was deposited in Genbank, NCBI with Accession No: AY278491 (SEQ ID NO:15), which is incorporated by reference. The isolated hSARS virus was deposited with China Center for Type Culture Collection (CCTCC) on Apr. 2, 2003 and accorded an accession number, CCTCC-V200303, as described in Section 7, infra, which is incorporated by reference. Also, the entire genome sequence of the hSARS virus, CCTCC-V200303, and characterization thereof are disclosed in a United States patent application with Attorney Docket No. V9661.0069 filed concurrently herewith on Mar. 24, 2004, which is incorporated by reference in its entirety. The virus mutates and changes rapidly and hence making the diagnostic of SARS very difficult. The present inventors have designed a diagnostic assay for detecting the presence of N-gene nucleic acid sequence or protein to rapidly, accurately, and specifically identify the hSARS virus. Furthermore, the present inventors have designed a diagnostic assay for detecting the presence of S-gene nucleic acid sequence or protein to determine the genetic diversity of the hSARS virus. Accordingly, the invention relates to methods of detecting nucleotide sequences of the N-gene and S-gene of the hSARS virus.

The present invention provides a rapid, reliable assay for the detection of hSARS virus. In preferred embodiment, the detection of hSARS virus includes the use of the nucleic acid molecules of the present invention in a polymerase chain reaction, Reverse transcription-Polymerase Chain Reaction (RT-PCR), Southern analysis, Northern analysis, or other nucleic acid hybridization for the detection of hSARS nucleic acids. In one embodiment, the invention provides methods for detecting the presence, activity or expression of the hSARS virus of the invention in a biological material, such as cells, nasopharyngeal aspirate, sputum, blood, saliva, urine, stool and so forth. In preferred embodiments, the biological material is nasopharyngeal aspirate or stool. The increased or decreased activity or expression of the hSARS virus in a sample relative to a control sample can be determined by contacting the biological material with an agent which can detect directly or indirectly the presence, activity or expression of the hSARS virus. In a specific embodiment, the detecting agents are the nucleic acid molecules of the present invention.

The present invention also relates to a method for identifying a subject infected with the hSARS virus, said method comprising obtaining total RNA from a biological sample obtained from the subject; reverse transcribing the total RNA to obtain cDNA; and subjecting the cDNA to PCR assay using a set of primers derived from a nucleotide sequence of the hSARS. In preferred embodiments, the primers are derived from the (nucleocapid) N-gene. In most preferred embodiments, the primers comprise the nucleotide sequences of SEQ ID NOS:2475 and/or 2476 or SEQ ID NOS:2480 and/or 2481. In another preferred embodiments, the primers are derived from the (spike) S-gene. In more preferred embodiments, the primers comprise the nucleotide sequences of SEQ ID NOS:2477 and/or 2478.

The invention further relates to the use of the sequence information of the isolated virus for diagnostic and therapeutic methods. In a specific embodiment, the invention provides nucleic acid molecules which are suitable for use as primers consisting of or comprising the nucleotide sequence of SEQ ID NO:1, 11, 13, 15, 2471, or 2473, or a complement thereof, or at least a portion of the nucleotide sequence thereof. In the most preferred embodiment, the primers comprise the nucleic acid sequence of SEQ ID NOS:2475 and/or 2476 or SEQ ID NOS:2480 and/or 2481 for the detection of N-gene. In another most preferred embodiment, the primers comprise the nucleic acid sequence of SEQ ID NO:2477 and/or 2478 for the detection of S-gene. In another specific embodiment, the invention provides nucleic acid molecules which are suitable for hybridization to hSARS nucleic acid, including, but not limited to, as PCR primers, Reverse Transcriptase primers, probes for Southern analysis or other nucleic acid hybridization analysis for the detection of hSARS nucleic acids, e.g., consisting of or comprising the nucleotide sequence of SEQ ID NO:1, 11, 13, 15, 2471, 2473, 2475, 2476, 2477, 2478, 2480 or 2481, or a complement thereof, or a portion thereof. In a preferred embodiment, primers that amplify fragments comprising (nucleotide position 18057 to 18222 or portions thereof of SEQ ID NO:15) 1b gene; (nucleotide position 21920-22107, or portions thereof of SEQ ID NO:15) M-gene; and (nucleotide position 28658-28883, or portions thereof of SEQ ID NO:15) N-gene may be used for probe synthesis for detection of hSARS nucleic acids. In a specific embodiment, the invention provides a diagnostic kit comprising nucleic acid molecules which are suitable for use to detect the N-gene of hSARS. In a specific embodiment, the N-gene comprises nucleic acid sequence of SEQ ID NO:2471. In specific embodiment, the nucleic acid molecules comprise nucleic acid sequence of SEQ ID NOS:2475 and/or 2476 or SEQ ID NOS:2480 and/or 2481. In preferred embodiments, the diagnostic kit further comprises a control for amplification of 1b gene. In specific embodiments, the primers used for amplifying 1 b gene are SEQ ID NOS:3 and/or 4. In another specific embodiments, the diagnostic kit further comprises an internal control using pig β-actin gene. In specific embodiments, the primers used for amplifying β-actin gene are SEQ ID NOS:2482 and/or 2483.

In a specific embodiment, the invention provides a diagnostic kit comprising nucleic acid molecules which are suitable for use to detect the S-gene of hSARS. In a specific embodiment, the S-gene comprises nucleic acid sequence of SEQ ID NO:2473. In specific embodiment, the nucleic acid molecules comprise nucleic acid sequence of SEQ ID NOS: 2477 and/or 2478. The invention further encompasses chimeric or recombinant viruses encoded in whole or in part by said nucleotide sequences.

In another specific embodiment, the invention provides nucleic acid molecules comprising a nucleotide sequence of SEQ ID NO:1, 11, 13, 2471, and/or 2473. In a specific embodiment, the present invention provides isolated nucleic acid molecules comprising or, alternatively, consisting of the nucleotide sequence of SEQ ID NO:1, a complement thereof or a portion thereof, preferably at least 5, 10, 15, 20, 25, 30, 35, 40, 45, 100, 150, 200, 300, 350, 400, 450, 500, 550, 600, or more contiguous nucleotides of the nucleotide sequence of SEQ ID NO:1, or a complement thereof. In another specific embodiment, the present invention provides isolated nucleic acid molecules comprising or, alternatively, consisting of the nucleotide sequence of SEQ ID NO:11, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, or more contiguous nucleotides of the nucleotide sequence of SEQ ID NO:11, or a complement thereof. In yet another specific embodiment, the present invention provides isolated nucleic acid molecules comprising or, alternatively, consisting of the nucleotide sequence of SEQ ID NO:13, a complement thereof or a portion thereof, preferably at least 5, 10, 15, 20, 25, 30, 35, 40, 45, 100, 150, 200, 300, 350, 400, 450, 500, 550, 600, 650, 700, or more contiguous nucleotides of the nucleotide sequence of SEQ ID NO:13, or a complement thereof. In another specific embodiment, the present invention provides isolated nucleic acid molecules comprising or, alternatively, consisting of the nucleotide sequence of SEQ ID NO:15, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:15, or a complement thereof. In another specific embodiment, the present invention provides isolated nucleic acid molecules comprising or, alternatively, consisting of the nucleotide sequence of SEQ ID NO:2471, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200 or more contiguous nucleotides of the nucleotide sequence of SEQ ID NO:2471, or a complement thereof. In another specific embodiment, the present invention provides isolated nucleic acid molecules comprising or, alternatively, consisting of the nucleotide sequence of SEQ ID NO:2473, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, or more contiguous nucleotides of the nucleotide sequence of SEQ ID NO:2473, or a complement thereof. Furthermore, in another specific embodiment, the invention provides isolated nucleic acid molecules which hybridize under stringent conditions, as defined herein, to a nucleic acid molecule having the sequence of SEQ ID NO:1, 11, 13, 15, 2471, or 2473, or a complement thereof. In one embodiment, the invention provides an isolated nucleic acid molecule which is antisense to the coding strand of a nucleic acid of the invention. In another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, or more contiguous nucleotides of the nucleotide sequence of SEQ ID NO:1, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200 or more contiguous nucleotides of the nucleotide sequence of SEQ ID NO:11, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, or more contiguous nucleotides of the nucleotide sequence of SEQ ID NO:13, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:15, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200 or more contiguous nucleotides of the nucleotide sequence of SEQ ID NO:2471, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, or more contiguous nucleotides of the nucleotide sequence of SEQ ID NO:2473, or a complement thereof. The invention further provides proteins or polypeptides that are isolated from the hSARS virus, including viral proteins isolated from cells infected with the virus but not present in comparable uninfected cells. The invention further provides proteins or polypeptides shown in FIGS. 11 (SEQ ID NOS:17-239, 241-736 and 738-1107) and 12 (SEQ ID NOS: 1109-1589, 1591-1964 and 1966-2470). The invention further provides proteins or polypeptides having the amino acid sequence of SEQ ID NO:2472 or 2474. The polypeptides or the proteins of the present invention preferably have a biological activity of the protein (including antigenicity and/or immunogenicity) encoded by the sequence of SEQ ID NO:1, 11, 13, 2471, or 2473. In other embodiments, the polypeptides or the proteins of the present invention have a biological acitivity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:15, or a complement thereof. In other embodiments, the polypeptides or the proteins of the present invention have a biological activity of the protein (including antigenicity and/or immunogenicity) of FIGS. 11 (SEQ ID NOS:17-239, 241-736 and 738-1107) and 12 (SEQ ID NOS:1109-1589, 1591-1964 and 1966-2470). The invention further provides proteins or polypeptides having a biological activity of the protein having amino acid sequence of SEQ ID NO:2472 or 2474.

In one aspect, the invention provides a method for propagating the hSARS virus in host cells comprising infecting the host cells with the isolated hSARS virus, culturing the host cells to allow the virus to multiply, and harvesting the resulting virions. Also provide by the present invention are host cells that are infected with the hSARS virus.

In one aspect, the invention relates to the use of the isolated hSARS virus for diagnostic and therapeutic methods. In a specific embodiment, the invention provides a method of detecting in a biological sample an antibody immunospecific for the hSARS virus using the isolated hSARS virus or any proteins or polypeptides thereof. In another specific embodiment, the invention provides a method of screening for an antibody which immunospecifically binds and neutralizes hSARS. Such an antibody is useful for a passive immunization or immunotherapy of a subject infected with hSARS.

The invention further provides antibodies that specifically bind a polypeptide of the invention encoded by the nucleotide sequence of SEQ ID NO:1, 11, 13, 2471, or 2473, or a fragment thereof, or encoded by a nucleic acid comprising a nucleotide sequence that hybridizes under stringent conditions to the nucleotide sequence of SEQ ID NO:1, 11, 13, 2471, or 2473, and/or any hSARS epitope, having one or more biological activities of a polypeptide of the invention. The invention further provides antibodies that specifically bind polypeptides of the invention encoded by the nucleotide sequence of SEQ ID NO:15, or a fragment thereof. These polypeptides include those shown in FIGS. 11 (SEQ ID NOS: 17-239, 241-736 and 738-1107) and 12 (SEQ ID NOS:1109-1589, 1591-1964 and 1966-2470). In another embodiment, the polypeptide comprises amino acid sequence of SEQ ID NO:2472, or 2474. The invention further provides antibodies that specifically bind polypeptides of the invention encoded by a nucleic acid comprising a nucleotide sequence that hybridizes under stringent conditions to the nucleotide sequence of SEQ ID NO:15, and/or any hSARS epitope, having one or more biological activities of a polypeptide of the invention. Such antibodies include, but are not limited to polyclonal, monoclonal, bi-specific, multi-specific, human, humanized, chimeric antibodies, single chain antibodies, Fab fragments, F(ab')$_2$ fragments, disulfide-linked Fvs, intrabodies and fragments containing either a Vl or VH domain or even a complementary determining region (CDR) that specifically binds to a polypeptide of the invention.

In another embodiment, the invention provides vaccine preparations, comprising the hSARS virus, including recombinant and chimeric forms of said virus, or protein subunits of the virus. In a specific embodiment, the vaccine preparations of the present invention comprise live but attenuated hSARS virus with or without adjuvants. In another specific embodiment, the vaccine preparations of the invention comprise an inactivated or killed hSARS virus. Such attenuated or inactivated viruses may be prepared by a series of passages of the virus through the host cells or by preparing recombinant or chimeric forms of virus. Accordingly, the present invention further provides methods of preparing recombinant or chimeric forms of hSARS. In another specific invention, the vaccine preparations of the present invention comprise a nucleic acid or fragment of the hSARS virus, e.g., the virus having accession no. CCTCC-V200303, or nucleic acid molecules having the sequence of SEQ ID NO. 1, 11, 13, 15, 2471 or 2473, or a fragment thereof. In another embodiment, the invention provides vaccine preparations comprising one or more polypeptides isolated from or produced from nucleic acid of hSARS virus, for example, of deposit accession no. CCTCC-V200303. In a specific embodiment, the vaccine preparations comprise a polypeptide of the invention encoded by the nucleotide sequence of SEQ ID NO:1, 11, 13, 2471 or 2473, or a fragment thereof. In a specific embodiment, the vaccine preparations comprise polypeptides of the invention as shown in FIGS. 11 (SEQ ID NOS:17-239, 241-736 and 738-1107) and 12 (SEQ ID NO:1109-1589, 1591-1964 AND 1966-2470) or encoded by the nucleotide sequence of SEQ ID NO:15, or a fragment thereof. In a specific embodiment, the vaccine preparations comprise polypeptides comprising amino acid sequence of SEQ ID NO:2472 or 2474. Furthermore, the present invention provides methods for treating, ameliorating, managing or preventing SARS by administering the vaccine preparations or antibodies of the present invention alone or in combination with adjuvants, or other pharmaceutically acceptable excipients.

In another aspect, the present invention provides pharmaceutical compositions comprising anti-viral agents of the present invention and a pharmaceutically acceptable carrier. In a specific embodiment, the anti-viral agent of the invention is an antibody that immunospecifically binds hSARS virus or any hSARS epitope. In preferred embodiments, such antibodies neutralize the hSARS virus. In a specific embodiment, the anti-viral agent of the invention binds a fragment, variant, homolog of N-gene or S-gene of hSARS virus. In a specific embodiment, the anti-viral agent of the invention binds a fragment, variant, homolog of a polypeptide comprising the amino acid sequence of SEQ ID NO:2472 or 2474. In another specific embodiment, the anti-viral agent is a polypeptide or protein of the present invention or nucleic acid molecule of the invention. The invention also provides kits containing a pharmaceutical composition of the present invention.

3.1 Definitions

The term "an antibody or an antibody fragment that immunospecifically binds a polypeptide of the invention" as used herein refers to an antibody or a fragment thereof that immunospecifically binds to the polypeptide encoded by the nucleotide sequence of SEQ ID NO:1, 11, 13, 15, 2471 2473, or the polypeptides shown in FIGS. 11 and 12, or a fragment thereof, and does not non-specifically bind to other polypeptides. An antibody or a fragment thereof that immunospecifically binds to the polypeptide of the invention may cross-react with other antigens. Preferably, an antibody or a fragment thereof that immunospecifically binds to a polypeptide of the invention does not cross-react with other antigens. An antibody or a fragment thereof that immunospecifically binds to the polypeptide of the invention, can be identified by, for example, immunoassays or other techniques known to those skilled in the art.

An "isolated" or "purified" peptide or protein is substantially free of cellular material or other contaminating proteins from the cell or tissue source from which the protein is derived, or substantially free of chemical precursors or other chemicals when chemically synthesized. The language "substantially free of cellular material" includes preparations of a polypeptide/protein in which the polypeptide/protein is separated from cellular components of the cells from which it is isolated or recombinantly produced. Thus, a polypeptide/protein that is substantially free of cellular material includes preparations of the polypeptide/protein having less than about 30%, 20%, 10%, 5%, 2.5%, or 1%, (by dry weight) of contaminating protein. When the polypeptide/protein is recombinantly produced, it is also preferably substantially free of culture medium, i.e., culture medium represents less than about 20%, 10%, or 5% of the volume of the protein preparation. When polypeptide/protein is produced by chemical synthesis, it is preferably substantially free of chemical precursors or other chemicals, i.e., it is separated from chemical precursors or other chemicals which are involved in the synthesis of the protein. Accordingly, such preparations of the polypeptide/protein have less than about 30%, 20%, 10%, 5% (by dry weight) of chemical precursors or compounds other than polypeptide/protein fragment of interest. In a preferred embodiment of the present invention, polypeptides/proteins are isolated or purified.

An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a preferred embodiment of the invention, nucleic acid molecules encoding polypeptides/proteins of the invention are isolated or purified. The term "isolated" nucleic acid molecule does not include a nucleic acid that is a member of a library that has not been purified away from other library clones containing other nucleic acid molecules.

The term "portion" or "fragment" as used herein refers to a fragment of a nucleic acid molecule containing at least about 25, 30, 35, 40, 45, 100, 150, 200, 250, 300, 350, 400, 450, 500, 550, 600, 650, 700, 750, 800, 850, 900, 950, 1000, 1050, 1100, 1150, 1200, 1250, 1300, 1350, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleic acids in length of the relevant nucleic acid molecule and having at least one functional feature of the nucleic acid molecule (or the encoded protein has one functional feature of the protein encoded by the nucleic acid molecule); or a fragment of a protein or a polypeptide containing at least 5, 10, 15, 20, 25, 30, 35, 40, 45, 50, 55, 60, 65, 70, 75, 80, 90, 100, 120, 140, 160, 180, 200, 220, 240, 260, 280, 300, 320, 340, 360, 400, 500, 600, 700, 800, 900, 1,000, 1,500, 2,000, 2,500, 3,000, 3,500, 4,000, 4,100, 4,200, 4,300, 4,350, 4,360, 4,370, 4,380 amino acid residues in length of the relevant protein or polypeptide and having at least one functional feature of the protein or polypeptide.

The term "3' region of the hSAR viral genome" refers to from about nucleotide position 18,000 to 29742 of SEQ ID NO:15.

The term "having a biological activity of the protein" or "having biological activities of the polypeptides of the invention" refers to the characteristics of the polypeptides or proteins having a common biological activity similar or identical structural domain and/or having sufficient amino acid identity to the polypeptide encoded by the nucleotide sequence of SEQ ID NO:1, 11, 13, 15, 16, 240, 737, 1108, 1590, 1965, 2471 or 2473. Such common biological activities of the polypeptides of the invention include antigenicity and immunogenicity.

The term "under stringent condition" refers to hybridization and washing conditions under which nucleotide sequences having at least 70%, at least 75%, at least 80%, at least 85%, at least 90%, or at least 95% identity to each other remain hybridized to each other. Such hybridization conditions are described in, for example but not limited to, Current Protocols in Molecular Biology, John Wiley & Sons, N.Y. (1989), 6.3.1-6.3.6.; Basic Methods in Molecular Biology, Elsevier Science Publishing Co., Inc., N.Y. (1986), pp. 75-78, and 84-87; and Molecular Cloning, Cold Spring Harbor Laboratory, N.Y. (1982), pp. 387-389, and are well known to those skilled in the art. A preferred, non-limiting example of stringent hybridization conditions is hybridization in 6× sodium chloride/sodium citrate (SSC), 0.5% SDS at about 68° C. followed by one or more washes in 2×SSC, 0.5% SDS at room temperature. Another preferred, non-limiting example of stringent hybridization conditions is hybridization in 6×SSC at about 45° C. followed by one or more washes in 0.2×SSC, 0.1% SDS at about 50-65° C.

The term "variant" as used herein refers either to a naturally occurring genetic mutant of hSARS or a recombinantly prepared variation of hSARS each of which contain one or more mutations in its genome compared to the hSARS of CCTCC-V200303. The term "variant" may also refers either to a naturally occurring variation of a given peptide or a recombinantly prepared variation of a given peptide or protein in which one or more amino acid residues have been modified by amino acid substitution, addition, or deletion.

4. BRIEF DESCRIPTION OF THE FIGURES

FIG. 1 shows a partial DNA sequence (SEQ ID NO:1) and its deduced amino acid sequence (SEQ ID NO:2) obtained from the SARS virus that has 57% homology to the RNA-dependent RNA polymerase protein of known Coronaviruses.

FIG. 2 shows an electron micrograph of the novel hSARS virus that has similar morphological characteristics of coronaviruses.

FIG. 3 shows an immunofluorescent staining for IgG antibodies that are specifically bound to the FrHK-4 cells infected with the novel human respiratory virus of Coronaviridae.

FIG. 4 shows an electron micrograph of ultra-centrifuged deposit of hSARS virus that was grown in the cell culture and negatively stained with 3% potassium phospho-tungstate at pH 7.0.

FIG. 5A shows a thin-section electron micrograph of lung biopsy of a patient with SARS; and FIG. 5B shows a thin section electron micrograph of hSARS-infected cells.

FIG. 6 shows the result of phylogenetic analysis for the partial protein sequence (215 amino acids; SEQ ID NO:2) of the hSARS virus (GenBank accession number AY268070). The phylogenetic tree is constructed by the neighbor-jointing method. The horizontal-line distance represents the number of sites at which the two sequences compared are different. Bootstrap values are deducted from 500 replicates.

FIG. 7A shows an amplification plot of fluorescence intensity against the PCR cycle in a real-time quantitative PCR assay that can detect a hSARS virus in samples quantitatively. The copy numbers of input plasmid DNA in the reactions are indicated. The X-axis denotes the cycle number of a quantitative PCR assay and the Y-axis denotes the fluorescence intensity (FI) over the backgroud. FIG. 7B shows the result of a melting curve analysis of PCR products from clinical samples. Signals from positive (+ve) samples, negative (−ve) samples and water control (water) are indicated. The X-axis denotes the temperature (° C.) and the Y-axis denotes the fluorescence intensity (F1) over the background.

FIG. 8 shows another partial DNA sequence (SEQ ID NO:11) and its deduced amino acid sequence (SEQ ID NO:12) obtained from the SARS virus.

FIG. 9 shows yet another partial DNA sequence (SEQ ID NO:13) and its deduced amino acid sequence (SEQ ID NO:14) obtained from the SARS virus.

FIG. 10 shows the entire genomic DNA sequence (SEQ ID NO:15) of the SARS virus.

FIG. 11 shows the deduced amino acid sequences obtained from SEQ ID NO:15 in three frames (see SEQ ID NOS:16, 240 and 737). An asterisk (*) indicates a stop codon which marks the end of a peptide. The first-frame amino acid sequences: SEQ ID NOS:17-239; the second-frame amino acid sequences: SEQ ID NOS:241-736; and the third-frame amino acid sequences: SEQ ID NO:738-1107.

FIG. 12 shows the deduced amino acid sequences obtained from the complement of SEQ ID NO:15 in three frames (see SEQ ID NOS:1108, 1590 and 1965). An asterisk (*) indicates a stop codon which marks the end of a peptide. The first-frame amino acid sequences: SEQ ID NOS:1109-1589; the second-frame amino acid sequences: SEQ ID NOS:1591-1964; and the third-frame amino acid sequences: SEQ ID NO:1966-2470.

FIG. 13 shows the N-gene primer sequences (which amplifies nucleotides at position 29247-29410 of SEQ ID NO:2471). 150# (SEQ ID NO:2475); 200# (SEQ ID NO:2476); and S-gene primer sequences (which amplifies nucleotides at position 24751 to 25049 of SEQ ID NO:2473). 131# (SEQ ID NO:2477); 132# (SEQ ID NO:2478).

FIG. 14A shows the nucleic acid sequence of the N-gene (SEQ ID NO:2471). FIG. 14B shows the amino acid sequence of the N-gene (SEQ ID NO:2472).

FIG. 15A shows the nucleic acid sequence of the S-gene (SEQ ID NO:2473). FIG. 15B shows the amino acid sequence of the S-gene (SEQ ID NO:2474).

FIG. 16 shows the genome organization and transcription strategy of SARS-CoV HK-39. Genomic and mRNA transcripts are capped (black circles), carry leader sequences (vertical lines)at 5'proximal and are polyadenylated ($A^{15}$). Arrows point the position of the intergenic sequence, 5'-CTAAACGAAC-3' (SEQ ID NO:2479). After release of the positive-sense genomic RNA in the cytoplasm of host cell, the viral RNA-dependent RNA polymerase, encoded from ORF 1a and 1b, is synthesized. It carries out transcription of a full-length complementary (negative-sense) RNA, from which new genomic RNA, an overlapping set of subgenomic mRNA transcripts, and leader RNA are synthesized. Note that all transcripts are preceded with common 5' leader sequences and common 3' ends. ORF1a and 1b—RNA-dependent RNA polymerase; S—the major peplomer glycoprotein; M—transmembrane glycoprotein; N—nucleocapsid; X1, X2, X3—putative proteins.

Figure 17:
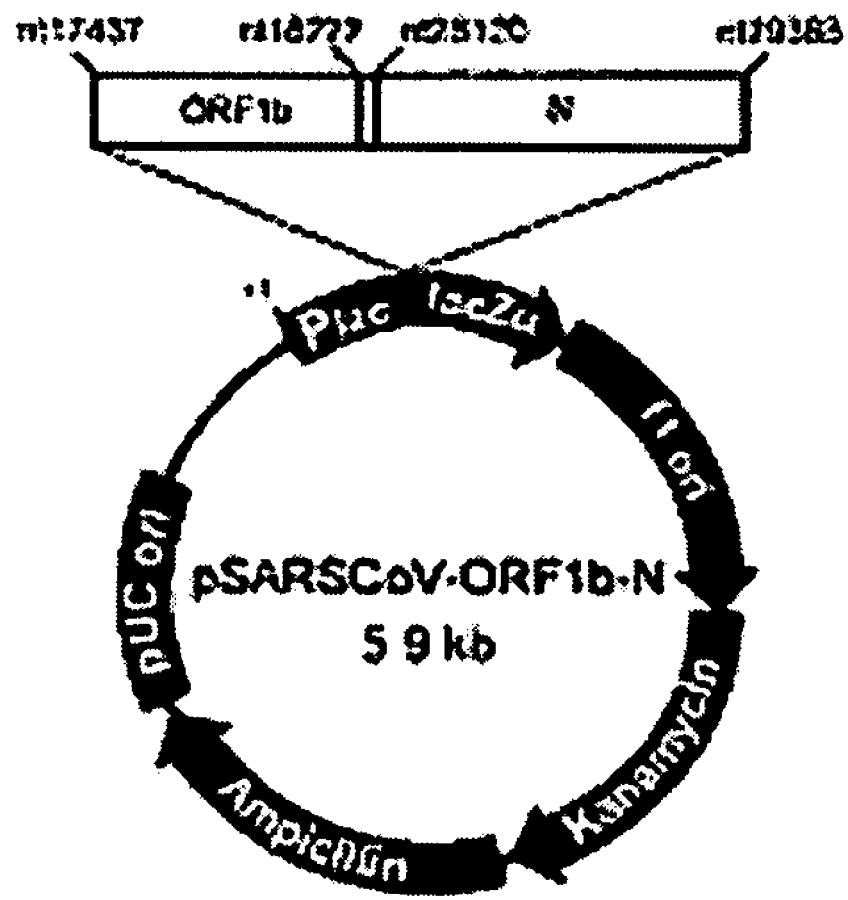

FIG. 17 shows a construct map of pSARSCoV-ORF 1b-N. PCR products amplified from ORF1b (1b) and N gene of SARS-CoV were co-ligated into a cloning vector pCR2.1-TOPO (Invitrogen). The nucleotide (nt) numbers corresponds to the positions in the sequence of HK-39 strain SARS-CoV (AY278491). Shadowed areas indicate the amplicons by the primers used in diagnostic test (i.e., SEQ ID NOS:2480 and 2481).

Figure 18:
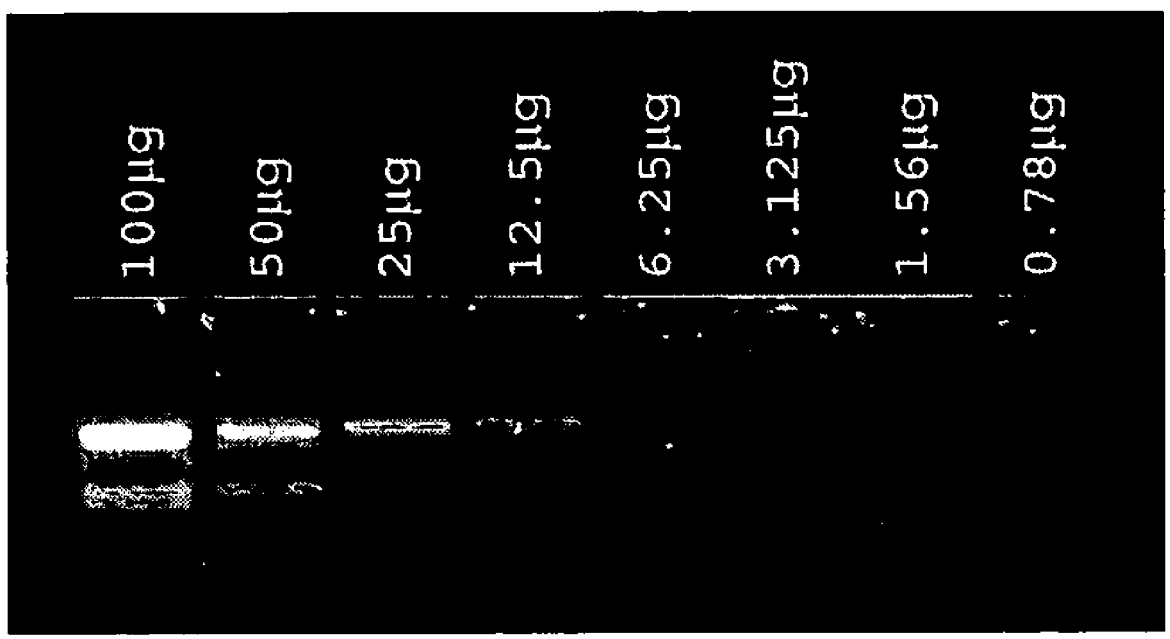

FIG. 18 shows a photo of an agarose gel after electrophoresis of total RNA extracted from SARS patients using SV Total RNA isolation system. The extracted RNA was then subjected to a reverse-transcription polymerase chain reaction (RT-PCR) assay for the detection of *coronavirus* in the patients.

Figure 19:
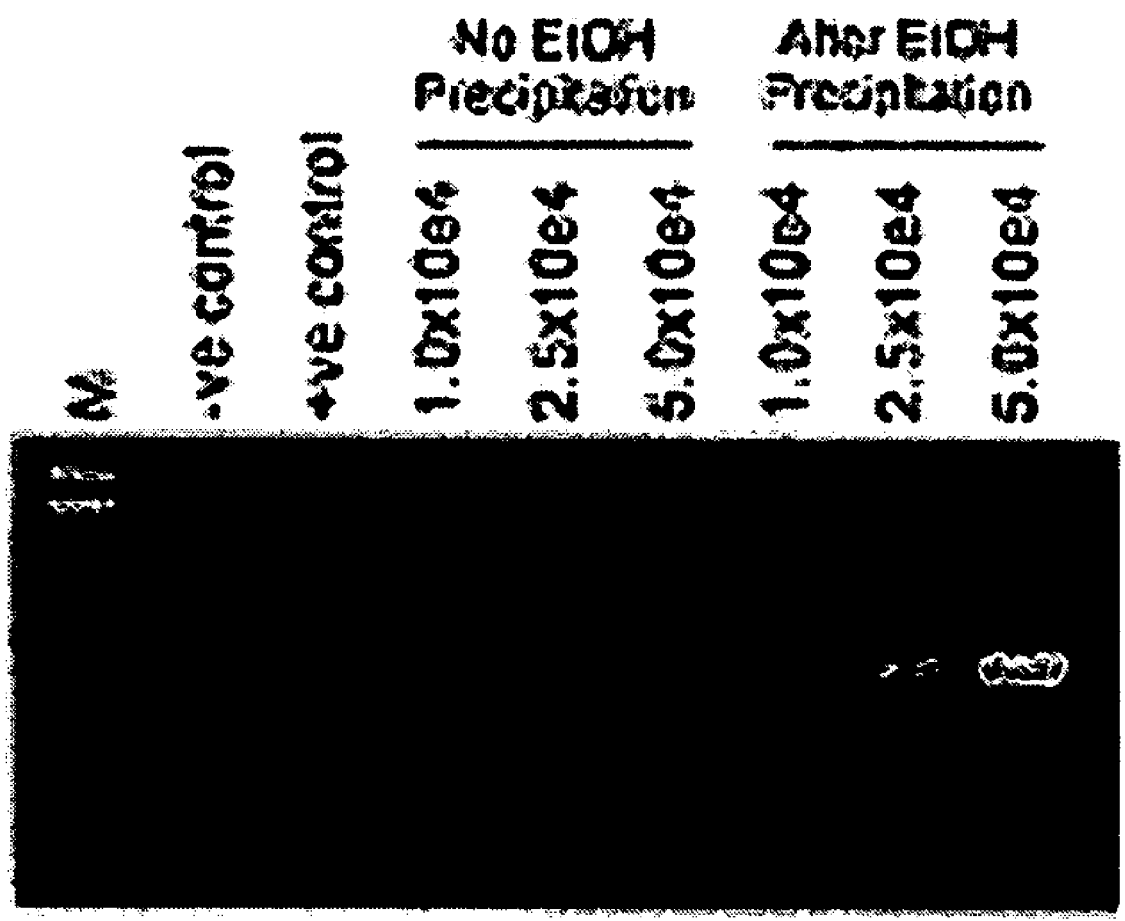

FIG. 19 shows the effect of potential inhibitors in Reverse Transcription Polymerase Chain Reaction (RT-PCR). To remove potential inhibitors, total RNA eluted from SV96 Binding Plate was precipitated with 95% ethanol and 3 M sodium acetate and resuspend in 12 µl of nuclease-free water. RT-PCR was performed with actin-F (SEQ ID NO:2482) and actin-R (SEQ ID NO:2483) primers. Numbers indicated were the number of pig kidney epithelial (PK-15) cell added in the sample as an internal control. There was no DNA fragment amplified with untreated RNA samples.

FIG. 20 shows the primers used for amplifying various genes. SRS251 (SEQ ID NO:2480) and SRS252 (SEQ ID NO:2481) amplified a 225 base pair fragment from the region of N-gene that showed no homology to other *coronavirus*. coro3 (SEQ ID NO:3) and coro4 (SEQ ID NO:4) amplified RNA-dependent RNA polymerase (1b gene) as a control. Actin-F (SEQ ID NO:2482) and actin-R (SEQ ID NO:2483) amplified a 745 base pair fragment from β-actin gene as internal control for PCR assays.

Figure 21A:
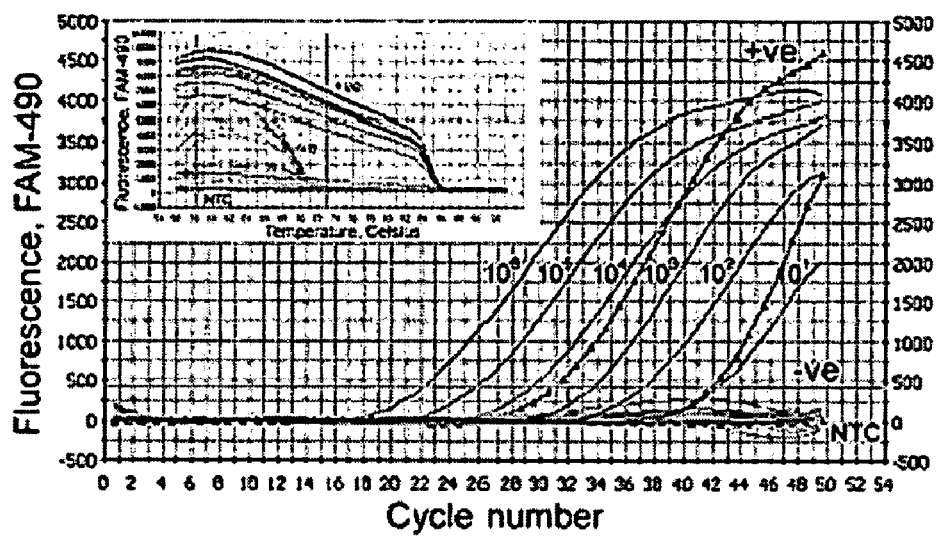
Figure 21B:
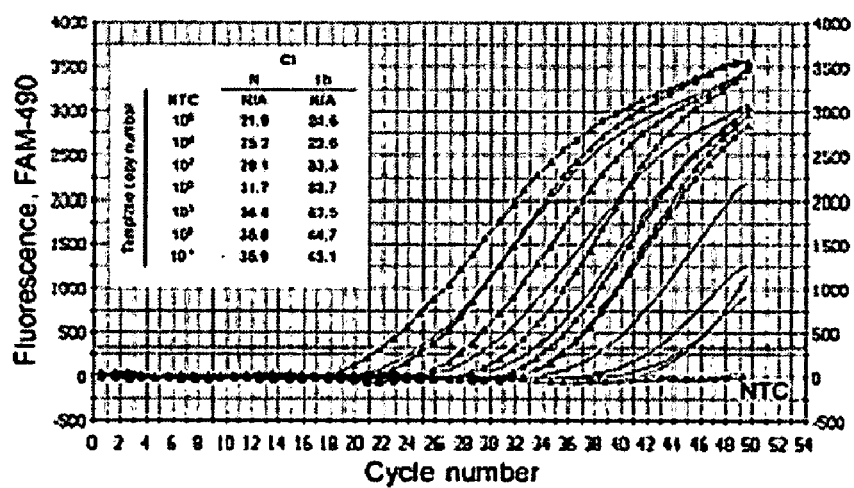

FIG. 21A shows Amplification plot of fluorescence Intensity against the number of PCR cycles. Black lines show the dynamic range of N-gene specific PCR with serially diluted plasmid construct from $10^1$ to $10^6$ copies. NPA samples from non-SARS patients, including patients suffering from adenovirus (n=5), respiratory syncytial virus (n=5), human metapneumovirus (n=5), influenza A virus (n=5), or influenza B virus (n=5) infection, are shown in gray lines. Lines with triangles denotes the SARS-CoV positive NPA samples; NTC represents no template control; X-axis indicates the cycle number of quantitative PCR performed, while Y-axis represents the fluorescence intensity (FAM-400) over background signal (Delta Rn). Inlet shows the melting curve analysis of the PCR products. Signals from positive (+ve), negative (−ve) samples and no template control are indicated. X-axis indicates the temperature (° C.), while Y-axis represents the fluorescence intensity (Delta Rn). FIG. 21B shows comparison of dynamic ranges of N-gene and 1b-gene specific PCRs. Dynamic ranges of both N-gene and 1b-gene PCR were obtained with same plasmid construct in which 1:1 ratio of corresponding amplicons were subcloned. Serially diluted plasmid with copy number ranged from $10^{-1}$ to $10^5$ copies was used as template in both PCRs. Lines with triangles denotes N-gene specific PCR while the gray lines indicates 1b-gene specific PCR. Inlet shows Ct values±standard deviation in triplicate set of experiment of both PCRs with different copy numbers of template used. NTC represents no template control; X-axis indicated the cycle number of quantitative PCR performed, while Y-axis represents fluorescence intensity.

Figure 22A:
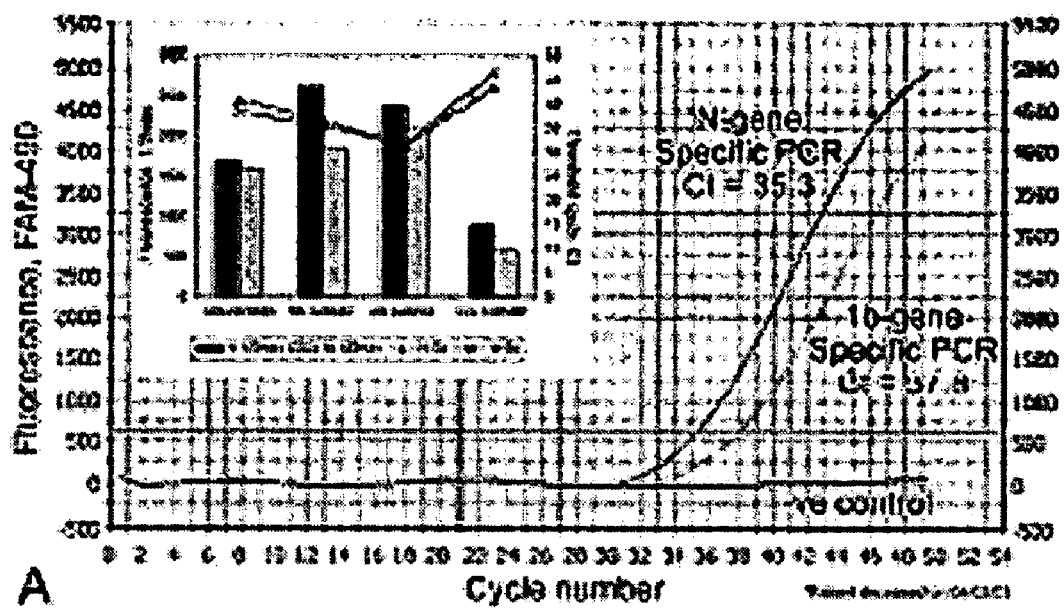
Figure 22B:
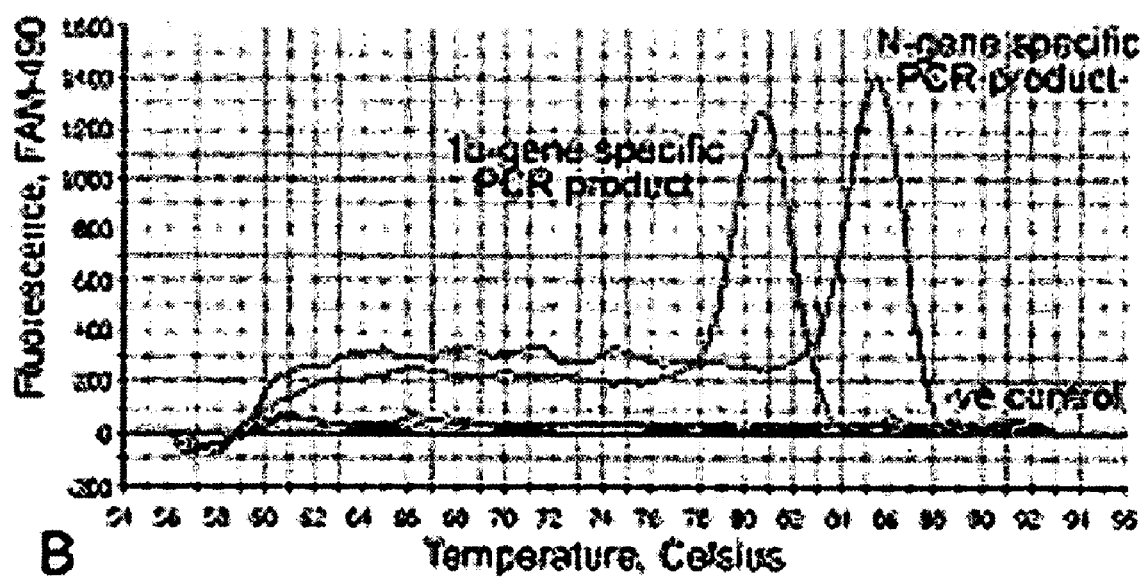

FIGS. 22A and 22B show an amplification curve and a melting curve, respectively, of real-time quantitative PCR specific to 1b (using the primers having SEQ ID NOS:3 and 4) and N gene (using the primers having SEQ ID NOS:2480 and 2481) of SARS CoV. FIG. 22A: Amplification plot of fluorescence intensity against the number of PCR cycles. One (1) µl of cDNA from a NPA, tracheal dispersion and lung biopsy of patients with clinical symptoms were used as template in each PCR. Fifty (50) cycles of PCR were performed to achieve the saturation phase of the reaction. X-axis indicates the cycle number of quantitative PCR performed, while y-axis represents the fluorescence intensity (FAM-490) over background signal. Horizontal gray line indicates the calculated threshold value by maximum curvature approach, and the baseline cycle Ct was calculated automatically. Inlet shows half-maximal fluorescence value (½ max) and Ct of both PCR with cDNA from various tissue isolated from a key patient (patient A indicated in *New Engl. J. Med.* 348:1967-76 (by Drosten et al., 2003) in three different time points. NPA=nasopharyngeal aspirate; TW=tracheal wash; LW=lung wash. FIG. 22B: Melting curves of PCR products. Melting curve analysis was carried out after 10-minute further-extension step of the reaction. The temperature was raised from 56° C. to 94° C. by 76 increments of 0.5° C. each, while each set-point temperature had been held for 7 seconds for data collection and analysis. Melting temperature of 1b- and N-gene specific PCR products was 80.5° C. and 85.5° C. respectively. X-axis indicates the temperature in degree Celsius while Y-axis represents the fluorescence intensity (FAM-490) over background signal. One (1) µl of water was used as no template control in the reaction.

Figure 23:
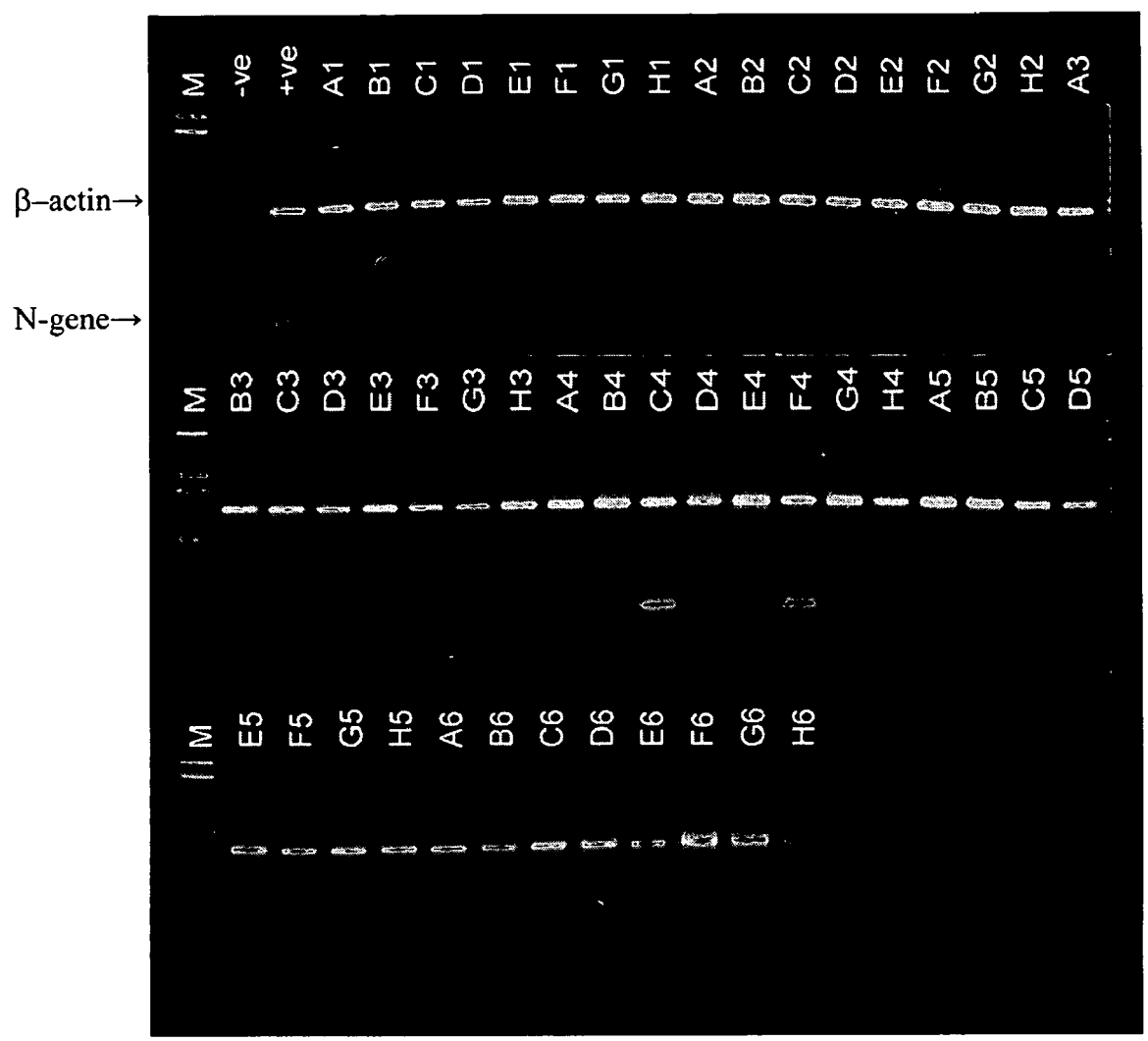

FIG. 23 shows the diagnostic result of 48 clinical samples using the primers having SEQ ID NOS:2480 and 2481, respectively, with β-actin PCR as an internal control. Upper bands in each row showed a 745 bp DNA fragment amplified with actin-F and actin-R, while lower bands were the amplicons by primers specific for N-gene of SARS *coronavirus* (225 bp). −ve control (water) and +ve control (cDNA from SARS *coronavirus* infected vero cell) of the assay were indicated. Five (5) µl of PCR products of both reactions were mixed and loaded into the sample well in a 2% agarose gel. M=1 kb plus molecular marker (Invitrogen).

Figure 24:
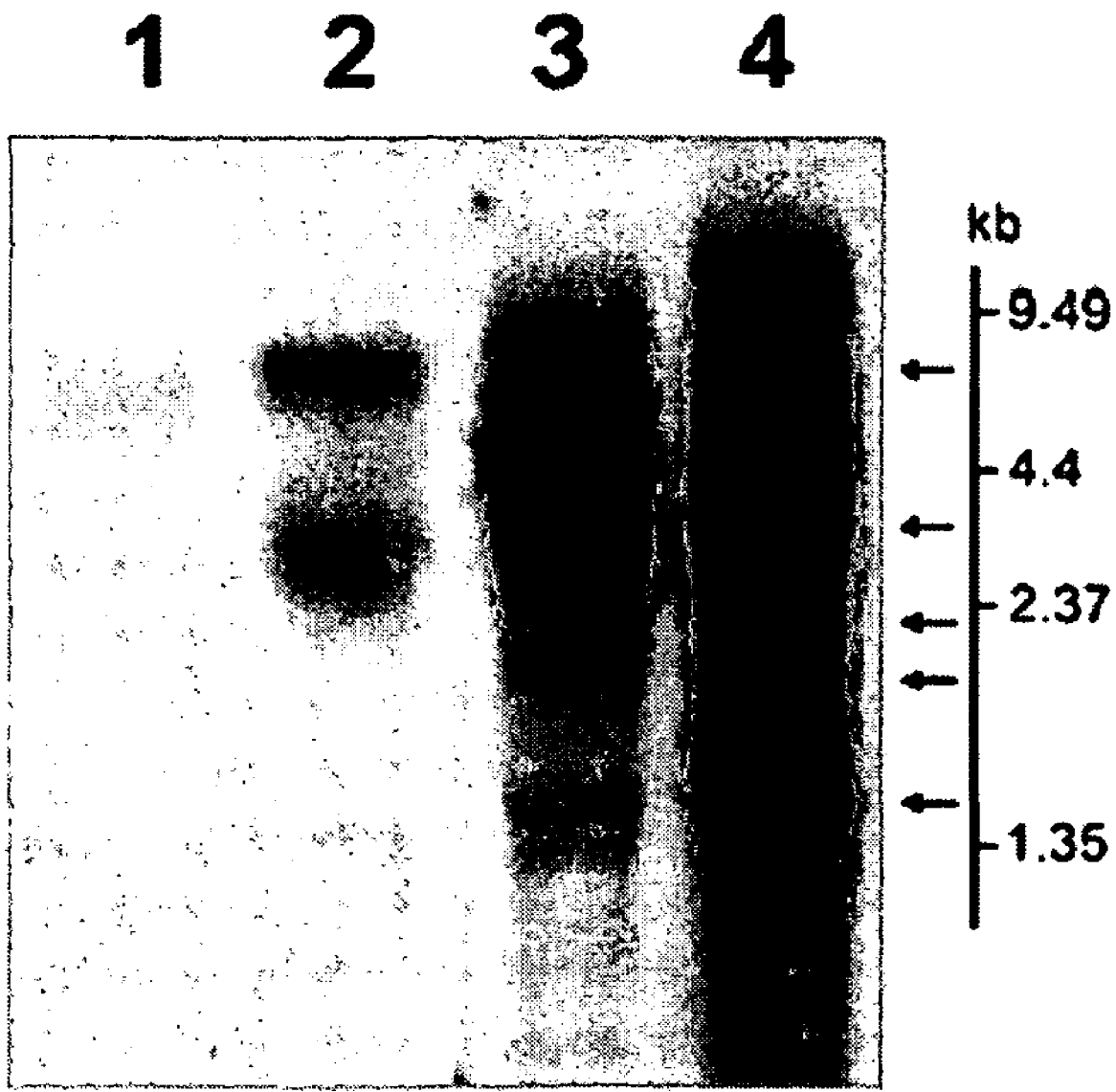

FIG. 24 shows Northern Blot analysis of SARS-CoV total RNA. Total RNA of SARS-CoV was extracted from SARS-CoV infected Vero E6 cell. RNA was separated in a 1% denaturing gel containing 6.29% formaldehyde. Afterwards RNA was transferred to positively charged nylon membrane and hybridized with digoxigenin-labelled PCR fragments specific to 1b, S, M and N genes, respectively. Lane 1-1b; lane 2-S; lane 3-M; lane 4-N. Vertical bar showed the molecular size reference. Arrows indicates the transcripts hybridized with N probe. Signals were analyzed by chemiluminescence.

FIG. 25 shows the DNA probes used in Nothern blot analysis. The probes for 1b gene (nt 18057-18222; SEQ ID NO:2484), S gene (nt 21920-22107; SEQ ID NO:2485), M gene (nt 25867-26996; SEQ ID NO:2486), and N gene (nt 28658-28883; SEQ ID NO:2487) are shown.

5. DETAILED DESCRIPTION OF THE INVENTION

The present inventors developed a rapid, high-throughput reverse transcription-PCR diagnostic test for SARS associated *coronavirus* (SARS-CoV). 3' region of the hSARS virus genome including the Nucleocapsid gene (N-gene) represents a sensitive molecular marker which can be used in addition to 1b gene to increase the sensitivity of the test. An internal control using PK-15 cells may be employed to ensure the integrity of RNA during its extraction process and cDNA synthesis, thus eliminating false negative results.

In mouse hepatitis virus (MHV), a typical member of the genus *Coronavirus*, both genomic RNA and mRNA transcripts are capped and with common 3' ends and common leader sequences on their 5' ends. With this unique transcription strategy, the copy numbers of different viral genes during proliferation of virus in its host are different (FIG. 19). N gene that encodes for the nucleocapsid has the most abundant copy number during virus replication as all transcripts may carry nucleotide sequence from N gene, although they are not all in-frame for translation for this gene product. The present inventors have discovered a diagnostic assay that is based on the 3' region, including the N-gene, of the viral genome provide a more sensitive assay than the rest of the viral genome. Accordingly, in preferred embodiments, nucleic acid molecules that may be used for a diagnostic assay comprise nucleic acid sequence of nucleotide position 18000 to 29742 of SEQ ID NO:15, or portions thereof. The portions may comprise 15, 20, 25, 30, 35, 40, 45, 100, 150, 200, 300, 350, 400, 450, 500, 550, 600, 650, 700, 750, 750, 800, 850, 900, 950, 1000, 1050, 1100, 1150, 1200 of nucleotides having nucleic acid sequence from nucleotide position 18000 to 29742 of SEQ ID NO:15. In other preferred embodiments, nucleic acid molecules that may be used for a diagnostic assay comprising nucleic acid sequence of nucleotide position 28658 to 28883 or 29247-29410 of SEQ ID NO:15.

Nasopharyngeal aspirate (NPA) and stool samples were obtained from SARS suspected patients with major clinical symptoms and significant history of close contact with infected patients. Total RNA was extracted from the subject samples, together with PK-15 cell as an internal control. Samples were analyzed by the reverse-transcription-PCR assay. Northern blot analysis was performed to show different subgenomic transcripts of the virus. Real-time quantitative PCR was employed to compare the sensitivity of two loci used in this diagnostic assay. In specific embodiments, PCR inhibitor was removed with ethanol precipitation after RNA extraction process.

In preferred embodiments, the present invention provides a method for detecting the presence or absence of nucleic acid of the N-gene in a biological sample. The method involves obtaining a biological sample from various sources and contacting the sample with a compound or an agent capable of detecting a nucleic acid (e.g., mRNA, genomic RNA) of the N-gene of the hSARS virus such that the presence of the N-gene is detected in the sample. In preferred embodiments, the N-gene may be detected using a labeled nucleic acid probe comprising of the nucleotide sequence of SEQ ID NO:2471, complement thereof, or a portion thereof. The portion may be 10, 20, 30, 40, 50, 100, 200, 400, 500, 600, 800, 1000, 1200 nucleotides in length. In preferred embodiments, primers comprising nucleotide sequence of SEQ ID NOS:2475 and/or 2476 or SEQ ID NOS:2480 and/or 2481 may be used to amplify a portion of the N-gene for detection.

A preferred agent for detecting hSARS mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence or SEQ ID NO:1, 11, 13, 15, 2471 or 2473, complement thereof, or a portion thereof, such as an oligonucleotide of at least 15, 20, 25, 30, 50, 100, 250, 500, 750, 1,000 or more contiguous nucleotides in length and sufficient to specifically hybridize under stringent conditions to a hSARS mRNA or genomic RNA.

In another preferred specific embodiment, the presence of N-gene is detected in the sample by an reverse transcription polymerase chain reaction (RT-PCR) using the primers that are constructed based on a partial nucleotide sequence of the N-gene or a genomic nucleic acid sequence of SEQ ID NO:15, or based on a nucleotide sequence of SEQ ID NO:1, 11, 13, 15, 2471, or 2473. In a non-limiting specific embodiment, preferred primers to be used in a RT-PCR method are: 5'-TACACACCTCAGC-GTTG-3' (SEQ ID NO:3) and/or 5'-CACGAACGTGACG-AAT-3' (SEQ ID NO:4), in the presence of 2.5 mM $MgCl_2$ and the thermal cycles are, for example, but not limited to, 94° C. for 8 min followed by 40 cycles of 94° C. for 1 min, 50° C. for 1 min, 72° C. for 1 min (also see Sections 6.7 and 6.8 infra). In preferred embodiments, the primers comprise nucleic acid sequence of SEQ ID NOS:2475 and 2476. In another preferred embodiment, the primers comprise nucleic acid sequence of SEQ ID NOS: 2480 and 2481. In preferred embodiments, the thermal cycles are 94° C. for 10 min followed by 40 cycles of 94° C. for 30 seconds, 56° C. for 30 seconds, 72° C. for 30 seconds, 72° C. for 10 minutes. In another preferred embodiment, the thermal cycles are 94° C. for 3 min followed by 40 cycles of 94° C. for 30 seconds, 56° C. for 30 seconds, 72° C. for 30 seconds, 72° C. for 10 minutes. In more preferred specific embodiment, the present invention provides a real-time quantitative PCR assay to detect the presence of hSARS virus in a biological sample by subjecting the cDNA obtained by reverse transcription of the extracted total RNA from the sample to PCR reactions using the specific primers, such as those having nucleotide sequences of SEQ ID NOS:3 and 4, and a fluorescence dye, such as SYBR® Green I, which fluoresces when bound non-specifically to double-stranded DNA. The fluorescence signals from these reactions are captured at the end of extension steps as PCR product is generated over a range of the thermal cycles, thereby allowing the quantitative determination of the viral load in the sample based on an amplification plot (see Section 6.7, infra).

In the preferred embodiment, the present invention provides a method for detecting the presence or absence of nucleic acid of the S-gene in a biological sample. The method involves obtaining a biological sample from various sources and contacting the sample with a compound or an agent capable of detecting a nucleic acid (e.g., MRNA, genomic RNA) of the S-gene of the hSARS virus such that the presence of the S-gene is detected in the sample. A preferred agent for detecting hSARS mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence or SEQ ID NO:1, 11, 13, 15, 2471, or 2473, or a portion thereof, such as an oligonucleotide of at least 15, 20, 25, 30, 50, 100, 250, 500, 750, 1,000 or more contiguous nucleotides in length and sufficient to specifically hybridize under stringent conditions to a hSARS mRNA or genomic RNA.

In another preferred specific embodiment, the presence of S-gene is detected in the sample by an reverse transcription polymerase chain reaction (RT-PCR) using the primers that are constructed based on a partial nucleotide sequence of the S-gene (SEQ ID NO:2473).

In vitro techniques for detection of mRNA include northern hybridizations, in situ hybridizations, RT-PCR, and RNase protection. In vitro techniques for detection of genomic RNA include nothern hybridizations, RT-PCT, and RNase protection.

The polynucleotides encoding the N-gene may be amplified before they are detected. The term "amplified" refers to the process of making multiple copies of the nucleic acid from a single polynucleotide molecule. The amplification of polynucleotides can be carried out in vitro by biochemical processes known to those of skill in the art. The amplification agent may be any compound or system that will function to accomplish the synthesis of primer extension products, including enzymes. Suitable enzymes for this purpose include, for example, *E. coli* DNA polymerase I, Taq polymerase, Klenow fragment of *E. coli* DNA polymerase I, T4 DNA polymerase, other available DNA polymerases, polymerase muteins, reverse transcriptase, ligase, and other enzymes, including heat-stable enzymes (i.e., those enzymes that perform primer extension after being subjected to temperatures sufficiently elevated to cause denaturation). Suitable enzymes will facilitate combination of the nucleotides in the proper manner to form the primer extension products that are complementary to each mutant nucleotide strand. Generally, the synthesis will be initiated at the 3'-end of each primer and proceed in the 5'-direction along the template strand, until synthesis terminates, producing molecules of different lengths. There may be amplification agents, however, that initiate synthesis at the 5'-end and proceed in the other direction, using the same process as described above. In any event, the method of the invention is not to be limited to the embodiments of amplification described herein.

One method of in vitro amplification, which can be used according to this invention, is the polymerase chain reaction (PCR) described in U.S. Pat. Nos. 4,683,202 and 4,683,195. The term "polymerase chain reaction" refers to a method for amplifying a DNA base sequence using a heat-stable DNA polymerase and two oligonucleotide primers, one complementary to the (+)-strand at one end of the sequence to be amplified and the other complementary to the (−)-strand at the other end. Because the newly synthesized DNA strands can subsequently serve as additional templates for the same primer sequences, successive rounds of primer annealing, strand elongation, and dissociation produce rapid and highly specific amplification of the desired sequence. The polymerase chain reaction is used to detect the presence of polynucleotides encoding cytokines in the sample. Many polymerase chain methods are known to those of skill in the art and may be used in the method of the invention. For example, DNA can be subjected to 30 to 35 cycles of amplification in a thermocycler as follows: 95° C. for 30 sec, 52° to 60° C. for 1 min, and 72° C. for 1 min, with a final extension step of 72° C. for 5 min. For another example, DNA can be subjected to 35 polymerase chain reaction cycles in a thermocycler at a denaturing temperature of 95° C. for 30 sec, followed by varying annealing temperatures ranging from 54-58° C. for 1 min, an extension step at 70° C. for 1 min and a final extension step at 70° C.

The primers for use in amplifying the N-gene or S-gene of the invention may be prepared using any suitable method, such as conventional phosphotriester and phosphodiester methods or automated embodiments thereof so long as the primers are capable of hybridizing to the polynucleotides of interest. One method for synthesizing oligonucleotides on a modified solid support is described in U.S. Pat. No. 4,458,066. The exact length of primer will depend on many factors, including temperature, buffer, and nucleotide composition. The primer must prime the synthesis of extension products in the presence of the inducing agent for amplification.

Primers used according to the method of the invention are complementary to each strand of nucleotide sequence to be amplified. The term "complementary" means that the primers must hybridize with their respective strands under conditions, which allow the agent for polymerization to function. In other words, the primers that are complementary to the flanking sequences hybridize with the flanking sequences and permit amplification of the nucleotide sequence. Preferably, the 3' terminus of the primer that is extended has perfectly base paired complementarity with the complementary flanking strand. Primers and probes for polynucleotides encoding N-gene or S-gene of the present invention can be developed using known methods combined with the present disclosure.

Those of ordinary skill in the art will know of various amplification methodologies that can also be utilized to increase the copy number of target nucleic acid. The polynucleotides detected in the method of the invention can be further evaluated, detected, cloned, sequenced, and the like, either in solution or after binding to a solid support, by any method usually applied to the detection of a specific nucleic acid sequence such as another polymerase chain reaction, oligomer restriction (Saiki et al., *Bio/Technology* 3:1008-1012 (1985)), allele-specific oligonucleotide (ASO) probe analysis (Conner et al., *Proc. Natl. Acad. Sci. USA* 80: 278 (1983), oligonucleotide ligation assays (OLAs) (Landegren et al., *Science* 241:1077 (1988)), RNAse Protection Assay and the like. Molecular techniques for DNA analysis have been reviewed (Landegren et al, *Science* 242: 229-237 (1988)). Following DNA amplification, the reaction product may be detected by Southern blot analysis, without using radioactive probes. In such a process, for example, a small sample of DNA containing the polynucleotides obtained from the tissue or subject are amplified, and analyzed via a Southern blotting technique. The use of non-radioactive probes or labels is facilitated by the high level of the amplified signal. In one embodiment of the invention, one nucleoside triphosphate is radioactively labeled, thereby allowing direct visualization of the amplification product by autoradiography. In another embodiment, amplification primers are fluorescently labeled and run through an electrophoresis system. Visualization of amplified products is by laser detection followed by computer assisted graphic display, without a radioactive signal.

The methods of the present invention can involve a real-time quantitative PCR assay, such as a Taqmang assay (Holland et al., *Proc Natl Acad Sci USA,* 88(16):7276 (1991); also see U.S. patent application of U.S. application Ser. No. 10/808,187 filed Mar. 24, 2004, which is incorporated by reference in its entirety). The assays can be performed on an instrument designed to perform such assays, for example those available from Applied Biosystems (Foster City, Calif.). Primers and probes for such an assay can be designed according to known procedures in the art.

The size of the primers used to amplify a portion of the N-gene or S-gene is at least 10, 15, 20, 25, 30 nucleotide in length. In particular, primers that amplify the N-gene or S-gene is most preferred. Preferably, the GC ratio should be above 30, 35, 40, 45, 50, 55, 60% so as to prevent hair-pin structure on the primer. Furthermore, the amplicon should be sufficiently long enough to be detected by standard molecular biology methodologies.

Preferably, the amplicon is at least 40, 60, 100, 200, 300, 400, 500, 600, 800, 1000 base pair in length.

In a specific embodiment, the methods further involve obtaining a control sample from a control subject, contacting the control sample with a compound or agent capable of detecting N-gene or S-gene, such that the presence of mRNA or genomic RNA encoding the N-gene or S-gene is detected in the sample, and comparing the presence (or absence) of N-gene or S-gene, or mRNA or genomic RNA encoding the polypeptide in the control sample with the presence of N-gene or S-gene, or mRNA or genomic DNA encoding the polypeptide in the test sample.

The invention also encompasses kits for detecting the presence of N-gene nucleic acid in a test sample. The kit, for example, can comprise a labeled compound or agent capable of detecting a nucleic acid molecule encoding the polypeptide in a test sample and, in certain embodiments, a means for determining the amount of mRNA in the sample (an oligonucleotide probe which binds to DNA or mRNA encoding the polypeptide).

For oligonucleotide-based kits, the kit can comprise, for example: (1) an oligonucleotide, e.g., a detectably labeled oligonucleotide, which hybridizes to a nucleic acid sequence encoding a polypeptide of the invention or to a sequence within the N-gene; (2) a pair of primers useful for amplifying a nucleic acid molecule containing the N-gene sequence. The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples which can be assayed and compared to the test sample contained. Each component of the kit is usually enclosed within an individual container and all of the various containers are within a single package along with instructions for use.

The present invention relates to the isolated N-gene and S-gene of the hSARS virus. In a specific embodiment, the virus comprises a nucleotide sequence of SEQ ID NO:1, 11, 13, 15, 2471, and/or 2473. In a specific embodiment, the present invention provides isolated nucleic acid molecules of the hSARS virus, comprising, or, alternatively consisting of the nucleotide sequence of SEQ ID NO:1, 11, 13, 15, 2471, and/or, 2473, a complement thereof or a portion thereof. In another specific embodiment, the invention provides isolated nucleic acid molecules which hybridize under stringent conditions, as defined herein, to a nucleic acid molecule having the sequence of SEQ ID NO:1, 11, 13, 15, 2471, and/or 2473, or specific genes of known member of Coronaviridae, or a complement thereof. In another specific embodiment, the invention provides isolated polypeptides or proteins that are encoded by a nucleic acid molecule comprising a nucleotide sequence that is at least about 5, 10, 15, 20, 25, 30, 35, 40, 45, 100, 150, 200, 300, 350, 400, 450, 500, 550, 600, or more contiguous nucleotides of the nucleotide sequence of SEQ ID NO:1, or a complement thereof. In another specific embodiment, the invention provides isolated polypeptides or proteins that are encoded by a nucleic acid molecule comprising a nucleotide sequence that is at least about 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, or more contiguous nucleotides of the nucleotide sequence of SEQ ID NO:11, or a complement thereof. In yet another specific embodiment, the invention provides isolated polypeptides or proteins that are encoded by a nucleic acid molecule comprising a nucleotide sequence that is at least about 5, 10, 15, 20, 25, 30, 35, 40, 45, 100, 150, 200, 300, 350, 400, 450, 500, 550, 600, 650, 700, or more contiguous nucleotides of the nucleotide sequence of SEQ ID NO:13, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200 or more contiguous nucleotides of the nucleotide sequence of SEQ ID NO:2471, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, or more contiguous nucleotides of the nucleotide sequence of SEQ ID NO:2473, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:15, or a complement thereof. The polypeptides includes those shown in FIGS. 11 (SEQ ID NOS:17-239, 241-736 and 738-1107) and 12 (SEQ ID NOS: 1109-1589, 1591-1964 and 1966-2470) or having an amino acid sequence of SEQ ID NO:2472 or 2474. The polypeptides or the proteins of the present invention preferably have one or more biological activities of the proteins encoded by the sequence of SEQ ID NO:1, 11, 13, 15, 2471 or 2473, or the polypeptides shown in FIGS. 11 and 12, or the native viral proteins containing the amino acid sequences encoded by the sequence of SEQ ID NO:1, 11, 13, 15, 2471 or 2473.

The present invention also relates to a method for propagating the hSARS virus in host cells.

The invention further relates to the use of the sequence information of the isolated virus for diagnostic and therapeutic methods. In a specific embodiment, the invention provides the entire nucleotide sequence of hSARS virus, CCTCC-V200303, SEQ ID NO:15, or fragments, or complement thereof. Furthermore, the present invention relates to a nucleic acid molecule that hybridizes any portion of the genome of the hSARS virus, CCTCC-V200303, or SEQ ID NO:15, under the stringent conditions. In a specific embodiment, the invention provides nucleic acid molecules which are suitable for use as primers consisting of or comprising the nucleotide sequence of SEQ ID NO:1, 11, 13, 15, 2471 or 2473, or a complement thereof, or a portion thereof. In specific embodiments, the primers comprise nucleotide sequence of SEQ ID NO:2475, 2476, 2477, 2478, 2480 or 2481. In another specific embodiment, the invention provides nucleic acid molecules which are suitable for use as hybridization probes for the detection of nucleic acids encoding a polypeptide of the invention, consisting of or comprising the nucleotide sequence of SEQ ID NO:1, 11, 13, 15, 2471 or 2473, a complement thereof, or a portion thereof The invention further relates to a kit comprising primers having nucleic acid sequence of SEQ ID NOS:2475 and 2476; and SEQ ID NOS:2480 and 2481, for the detection of N-gene. In another embodiment, the invention relates to a kit comprising primers having nucleic acid sequence of SEQ ID NOS:2477 and/or 2478 for the detection of S-gene. In a preferred embodiment, the kit further comprises reagents for the detection of genes not found in hSARS virus as a negative control. The invention further encompasses chimeric or recombinant viruses or viral proteins encoded by said nucleotide sequences.

The invention further provides antibodies that specifically bind a polypeptide of the invention encoded by the nucleotide sequence of SEQ ID NO:1, 11, 13, 2471 or 2473, or a fragment thereof, or any hSARS epitope. The invention further provides antibodies that specifically bind a polypeptide having amino acid sequence of SEQ ID NO:2472 or 2474. The invention further provides antibodies that specifically bind the polypeptides of the invention encoded by the nucleotide sequence of SEQ ID NO:15, or the polypeptides shown in FIGS. 11 and 12, or a fragment thereof, or any hSARS epitope. Such antibodies include, but are not limited to polyclonal, monoclonal, bi-specific, multi-specific, human, humanized, chimeric antibodies, single chain antibodies, Fab fragments, F(ab')$_2$ fragments, disulfide-linked Fvs, intrabodies and fragments containing either a Vl or VH domain or even a complementary determining region (CDR) that specifically binds to a polypeptide of the invention.

In one embodiment, the invention provides methods for detecting the presence, activity or expression of the hSARS virus of the invention in a biological material, such as cells, blood, saliva, urine, sputum, nasopharyngeal aspirates, and so forth. The presence of the hSARS virus in a sample can be determined by contacting the biological material with an agent which can detect directly or indirectly the presence of the hSARS virus. In a specific embodiment, the detection agents are the antibodies of the present invention. In another embodiment, the detection agent is a nucleic acid of the present invention.

In another embodiment, the invention provides vaccine preparations comprising the hSARS virus, including recombinant and chimeric forms of said virus, or subunits of the virus. In a specific embodiment, the vaccine preparations comprise live but attenuated hSARS virus with or without pharmaceutically acceptable excipients, including adjuvants. In another specific embodiment, the vaccine preparations comprise an inactivated or killed hSARS virus with or without pharmaceutically acceptable excipients, including adjuvants. The vaccine preparations of the present invention may further comprise with adjuvants or Accordingly, the present invention further provides methods of preparing recombinant or chimeric forms of hSARS. In another specific invention, the vaccine preparations of the present invention comprise one or more nucleic acid molecules comprising or consisting of the sequence of SEQ ID NO. 1, 11, 13, 15, 2471 and/or 2473, or a fragment thereof. In another embodiment, the invention provides vaccine preparations comprising one or more polypeptides of the invention encoded by a nucleotide sequence comprising or consisting of the nucleotide sequence of SEQ ID NO:1, 11, 13, 2471 and/or 2473, or the polypeptides shown in FIGS. 11 and 12, or a fragment thereof. In another embodiment, the invention provides vaccine preparations comprising one or more polypeptides of the invention encoded by a nucleotide sequence comprising or consisting of the nucleotide sequence of SEQ ID NO:15, or a fragment thereof. Furthermore, the present invention provides methods for treating, ameliorating, managing, or preventing SARS by administering the vaccine preparations or antibodies of the present invention alone or in combination with antivirals [e.g., amantadine, rimantadine, gancyclovir, acyclovir, ribavirin, penciclovir, oseltamivir, foscarnet zidovudine (AZT), didanosine (ddI), lamivudine (3TC), zalcitabine (ddC), stavudine (d4T), nevirapine, delavirdine, indinavir, ritonavir, vidarabine, nelfinavir, saquinavir, relenza, tamiflu, pleconaril, interferons, etc.], steroids and corticosteroids such as prednisone, cortisone, fluticasone and glucocorticoid, antibiotics, analgesics, bronchodialaters, or other treatments for respiratory and/or viral infections.

Furthermore, the present invention provides pharmaceutical compositions comprising anti-viral agents of the present invention and a pharmaceutically acceptable carrier. The present invention also provides kits comprising pharmaceutical compositions of the present invention.

In another aspect, the present invention provides methods for screening anti-viral agents that inhibit the infectivity or replication of hSARS virus or variants thereof.

5.1 Recombinant and Chimeric hSARS Viruses

The present invention encompasses recombinant or chimeric viruses encoded by viral vectors derived from the genome of hSARS virus or natural variants thereof. In a specific embodiment, a recombinant virus is one derived from the hSARS virus of deposit accession no. CCTCC-V200303. In a specific embodiment, the virus has a nucleotide sequence of SEQ ID NO:15. In another specific embodiment, a recombinant virus is one derived from a natural variant of hSARS virus. A natural variant of hSARS has a sequence that is different from the genomic sequence (SEQ ID NO:15) of the hSARS virus, CCTCC-V200303, due to one or more naturally occurred mutations, including, but not limited to, point mutations, rearrangements, insertions, deletions etc., to the genomic sequence that may or may not result in a phenotypic change. In accordance with the present invention, a viral vector which is derived from the genome of the hSARS virus, CCTCC-V200303, is one that contains a nucleic acid sequence that encodes at least a part of one ORF of the hSARS virus. In a specific embodiment, the ORF comprises or consists of a nucleotide sequence of SEQ ID NO:1, 11, 13, 2471, 2473, or a fragment thereof. In a specific embodiment, there are more than one ORF within the nucleotide sequence of SEQ ID NO:15, as shown in FIGS. 11 (SEQ ID NOS:16, 240 and 737) and 12 (SEQ ID NOS:1108, 1590 and 1965), or a fragment thereof. In another embodiment, the polypeptide encoded by the ORF comprises or consists of an amino acid sequence of SEQ ID NO:2, 12, 14, 2472, 2474, or a fragment thereof, or shown in FIGS. 11 (SEQ ID NOS:17-239, 241-736 and 738-1107) and 12 (SEQ ID NOS:1109-1589, 1591-1964 and 1966-2470), or a fragment thereof. In accordance with the present invention these viral vectors may or may not include nucleic acids that are non-native to the viral genome.

In another specific embodiment, a chimeric virus of the invention is a recombinant hSARS virus which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

According to the present invention, the chimeric viruses are encoded by the viral vectors of the invention which further comprise a heterologous nucleotide sequence. In accordance with the present invention a chimeric virus is encoded by a viral vector that may or may not include nucleic acids that are non-native to the viral genome. In accordance with the invention a chimeric virus is encoded by a viral vector to which heterologous nucleotide sequences have been added, inserted or substituted for native or non-native sequences. In accordance with the present invention, the chimeric virus may be encoded by nucleotide sequences derived from different strains or variants of hSARS virus. In particular, the chimeric virus is encoded by nucleotide sequences that encode antigenic polypeptides derived from different strains or variants of hSARS virus.

A chimeric virus may be of particular use for the generation of recombinant vaccines protecting against two or more viruses (Tao et al., J. Virol. 72, 2955-2961; Durbin et al., 2000, J. Virol. 74, 6821-6831; Skiadopoulos et al., 1998, J. Virol. 72, 1762-1768 (1998); Teng et al., 2000, J. Virol. 74, 9317-9321). For example, it can be envisaged that a virus vector derived from the hSARS virus expressing one or more proteins of variants of hSARS virus, or vice versa, will protect a subject vaccinated with such vector against infections by both the native hSARS and the variant. Attenuated and replication-defective viruses may be of use for vaccination purposes with live vaccines as has been suggested for other viruses. (See, PCT WO 02/057302, at pp. 6 and 23, incorporated by reference herein).

In accordance with the present invention the heterologous sequence to be incorporated into the viral vectors encoding the recombinant or chimeric viruses of the invention include sequences obtained or derived from different strains or variants of hSARS.

In certain embodiments, the chimeric or recombinant viruses of the invention are encoded by viral vectors derived from viral genomes wherein one or more sequences, intergenic regions, termini sequences, or portions or entire ORF have been substituted with a heterologous or non-native sequence. In certain embodiments of the invention, the chimeric viruses of the invention are encoded by viral vectors derived from viral genomes wherein one or more heterologous sequences have been inserted or added to the vector.

The selection of the viral vector may depend on the species of the subject that is to be treated or protected from a viral infection. If the subject is human, then an attenuated hSARS virus can be used to provide the antigenic sequences.

In accordance with the present invention, the viral vectors can be engineered to provide antigenic sequences which confer protection against infection by the hSARS and natural variants thereof. The viral vectors may be engineered to provide one, two, three or more antigenic sequences. In accordance with the present invention the antigenic sequences may be derived from the same virus, from different strains or variants of the same type of virus, or from different viruses.

The expression products and/or recombinant or chimeric virions obtained in accordance with the invention may advantageously be utilized in vaccine formulations. The expression products and chimeric virions of the present invention may be engineered to create vaccines against a broad range of pathogens, including viral and bacterial antigens, tumor antigens, allergen antigens, and auto antigens involved in autoimmune disorders. In particular, the chimeric virions of the present invention may be engineered to create vaccines for the protection of a subject from infections with hSARS virus and variants thereof.

In certain embodiments, the expression products and recombinant or chimeric virions of the present invention may be engineered to create vaccines against a broad range of pathogens, including viral antigens, tumor antigens and autoantigens involved in autoimmune disorders. One way to achieve this goal involves modifying existing hSARS genes to contain foreign sequences in their respective external domains. Where the heterologous sequences are epitopes or antigens of pathogens, these chimeric viruses may be used to induce a protective immune response against the disease agent from which these determinants are derived.

Thus, the present invention relates to the use of viral vectors and recombinant or chimeric viruses to formulate vaccines against a broad range of viruses and/or antigens. The present invention also encompasses recombinant viruses comprising a viral vector derived from the hSARS or variants thereof which contains sequences which result in a virus having a phenotype more suitable for use in vaccine formulations, e.g., attenuated phenotype or enhanced antigenicity. The mutations and modifications can be in coding regions, in intergenic regions and in the leader and trailer sequences of the virus.

The invention provides a host cell comprising a nucleic acid or a vector according to the invention. Plasmid or viral vectors containing the polymerase components of hSARS virus are generated in prokaryotic cells for the expression of the components in relevant cell types (bacteria, insect cells, eukaryotic cells). Plasmid or viral vectors containing full-length or partial copies of the hSARS genome will be generated in prokaryotic cells for the expression of viral nucleic acids in-vitro or in-vivo. The latter vectors may contain other viral sequences for the generation of chimeric viruses or chimeric virus proteins, may lack parts of the viral genome for the generation of replication defective virus, and may contain mutations, deletions or insertions for the generation of attenuated viruses. In addition, the present invention provides a host cell infected with hSARS virus, for example, of deposit no. CCTCC-V200303.

Infectious copies of hSARS (being wild type, attenuated, replication-defective or chimeric) can be produced upon co-expression of the polymerase components according to the state-of-the-art technologies described above.

In addition, eukaryotic cells, transiently or stably expressing one or more full-length or partial hSARS proteins can be used. Such cells can be made by transfection (proteins or nucleic acid vectors), infection (viral vectors) or transduction (viral vectors) and may be useful for complementation of mentioned wild type, attenuated, replication-defective or chimeric viruses.

The viral vectors and chimeric viruses of the present invention may be used to modulate a subject's immune system by stimulating a humoral immune response, a cellular immune response or by stimulating tolerance to an antigen. As used herein, a subject means: humans, primates, horses, cows, sheep, pigs, goats, dogs, cats, avian species and rodents.

5.2 Formulation of Vaccines and Antivirals

In a preferred embodiment, the invention provides a proteinaceous molecule or hSARS virus specific viral protein or functional fragment thereof encoded by a nucleic acid according to the invention. Useful proteinaceous molecules are for example derived from any of the genes or genomic fragments derivable from the virus according to the invention, including envelop protein (E protein), integral membrane protein (M protein), spike protein (S protein), nucleocapsid protein (N protein), hemaglutinin esterase (HE protein), and RNA-dependent RNA polymerase. Such molecules, or antigenic fragments thereof, as provided herein, are for example useful in diagnostic methods or kits and in pharmaceutical compositions such as subunit vaccines. Particularly useful are polypeptides encoded by the nucleotide sequence of SEQ ID NO:1, 11, 13, 15, 2471, 2473, or as shown in FIG. 11 (SEQ ID NOS:17-239, 241-736 and 738-1107) and FIG. 12 (SEQ ID NOS:1109-1589, 1591-1964 and 1966-2470), or having the amino acid sequence of SEQ ID NO:2472 or 2474, or antigenic fragments thereof for inclusion as antigen or subunit immunogen, but inactivated whole virus can also be used. Particularly useful are also those proteinaceous substances that are encoded by recombinant nucleic acid fragments of the hSARS genome, of course preferred are those that are within the preferred bounds and metes of ORFs, in particular, for eliciting hSARS specific antibody or T cell responses, whether in vivo (e.g. for protective or therapeutic purposes or for providing diagnostic antibodies) or in vitro (e.g. by phage display technology or another technique useful for generating synthetic antibodies).

The invention provides vaccine formulations for the prevention and treatment of infections with hSARS virus. In certain embodiments, the vaccine of the invention comprises recombinant and chimeric viruses of the hSARS virus. In certain embodiments, the virus is attenuated.

In another embodiment of this aspect of the invention, inactivated vaccine formulations may be prepared using conventional techniques to "kill" the chimeric viruses. Inactivated vaccines are "dead" in the sense that their infectivity has been destroyed. Ideally, the infectivity of the virus is destroyed without affecting its immunogenicity. In order to prepare inactivated vaccines, the chimeric virus may be grown in cell culture or in the allantois of the chick embryo, purified by zonal ultracentrifugation, inactivated by formaldehyde or β-propiolactone, and pooled. The resulting vaccine is usually inoculated intramuscularly.

Inactivated viruses may be formulated with a suitable adjuvant in order to enhance the immunological response. Such adjuvants may include but are not limited to mineral gels, e.g., aluminum hydroxide; surface active substances such as lysolecithin, pluronic polyols, polyanions; peptides; oil emulsions; and potentially useful human adjuvants such as BCG and *Corynebacterium parvum*.

In another aspect, the present invention also provides DNA vaccine formulations comprising a nucleic acid or fragment of the hSARS virus, e.g., the virus having accession no. CCTCC-V200303, or nucleic acid molecules having the sequence of SEQ ID NO:1, 11, 13, 15, 2471, 2473, or a fragment thereof. In another specific embodiment, the DNA vaccine formulations of the present invention comprises a nucleic acid or fragment thereof encoding the antibodies which immunospecifically binds hSARS viruses. In DNA vaccine formulations, a vaccine DNA comprises a viral vector, such as that derived from the hSARS virus, bacterial plasmid, or other expression vector, bearing an insert comprising a nucleic acid molecule of the present invention operably linked to one or more control elements, thereby allowing expression of the vaccinating proteins encoded by said nucleic acid molecule in a vaccinated subject. Such vectors can be prepared by recombinant DNA technology as recombinant or chimeric viral vectors carrying a nucleic acid molecule of the present invention (see also Section 5.1, supra).

Various heterologous vectors are described for DNA vaccinations against viral infections. For example, the vectors described in the following references may be used to express hSARS sequences instead of the sequences of the viruses or other pathogens described; in particular, vectors described for hepatitis B virus (Michel, M. L. et al., 1995, DAN-mediated immunization to the hepatitis B surface antigen in mice: Aspects of the humoral response mimic hepatitis B viral infection in humans, *Proc. Natl. Aca. Sci. USA* 92:5307-5311; Davis, H. L. et al., 1993, DNA-based immunization induces continuous seretion of hepatitis B surface antigen and high levels of circulating antibody, *Human Molec. Genetics* 2:1847-1851), HIV virus (Wang, B. et al., 1993, Gene inoculation generates immune responses against human imunodeficiency virus type 1, *Proc. Natl. Acad. Sci. USA* 90:4156-4160; Lu, S. et al., 1996, Simian immunodeficiency virus DNA vaccine trial in macques, *J. Virol.* 70:3978-3991; Letvin, N. L. et al., 1997, Potent, protective anti-HIV immune responses generated by bimodal HIV envelope DNA plus protein vaccination, *Proc Natl Acad Sci USA*. 94(17):9378-83), and influenza viruses (Robinson, H l et al., 1993, Protection against a lethal influenza virus challenge by immunization with a haemagglutinin-expressing plasmid DNA, *Vaccine* 11:957-960; Ulmer, J. B. et al., Heterologous protection against influenza by injection of DNA encoding a viral protein, *Science* 259:1745-1749), as well as bacterial infections, such as tuberculosis (Tascon, R. E. et al., 1996, Vaccination against tuberculosis by DNA injection, *Nature Med.* 2:888-892; Huygen, K. et al., 1996, Immunogenicity and protective efficacy of a tuberculosis DNA vaccine, *Nature Med.*, 2:893-898), and parasitic infection, such as malaria (Sedegah, M., 1994, Protection against malaria by immunization with plasmid DNA encoding circumsporozoite protein, *Proc. Natl. Acad. Sci. USA* 91:9866-9870; Doolan, D. L. et al., 1996, Circumventing genetic restriction of protection against malaria with multigene DNA immunization: CD8+ T cell-interferon δ, and nitric oxide-dependent immunity, *J. Exper. Med.*, 1183:1739-1746).

Many methods may be used to introduce the vaccine formulations described above. These include, but are not limited to, oral, intradermal, intramuscular, intraperitoneal, intravenous, subcutaneous, and intranasal routes. Alternatively, it may be preferable to introduce the chimeric virus vaccine formulation via the natural route of infection of the pathogen for which the vaccine is designed. The DNA vaccines of the present invention may be administered in saline solutions by injections into muscle or skin using a syringe and needle (Wolff J. A. et al., 1990, Direct gene transfer into mouse muscle in vivo, *Science* 247:1465-1468; Raz, E., 1994, Intradermal gene immunization: The possible role of DNA uptake in the induction of cellular immunity to viruses, *Proc. Natl. Acd. Sci. USA* 91:9519-9523). Another way to administer DNA vaccines is called "gene gun" method, whereby microscopic gold beads coated with the DNA molecules of interest is fired into the cells (Tang, D. et al, 1992, Genetic immunization is a simple method for eliciting an immune response, *Nature* 356:152-154). For general reviews of the methods for DNA vaccines, see Robinson, H. L., 1999, DNA vaccines: basic mechanism and immune responses (Review), *Int. J. Mol. Med.* 4(5):549-555; Barber, B., 1997, Introduction: Emerging vaccine strategies, *Seminars in Immunology* 9(5): 269-270; and Robinson, H. L. et al., 1997, DNA vaccines, *Seminars in Immunology* 9(5):271-283.

5.3 Attenuation of hSARS Virus or Variants Thereof

The hSARS virus or variants thereof of the invention can be genetically engineered to exhibit an attenuated phenotype. In particular, the viruses of the invention exhibit an attenuated phenotype in a subject to which the virus is administered as a vaccine. Attenuation can be achieved by any method known to a skilled artisan. Without being bound by theory, the attenuated phenotype of the viruses of the invention can be caused, e.g., by using a virus that naturally does not replicate well in an intended host species, for example, by reduced replication of the viral genome, by reduced ability of the virus to infect a host cell, or by reduced ability of the viral proteins to assemble to an infectious viral particle relative to the wild type strain of the virus.

The attenuated phenotypes of hSARS virus or variants thereof can be tested by any method known to the artisan. A candidate virus can, for example, be tested for its ability to infect a host or for the rate of replication in a cell culture system. In certain embodiments, growth curves at different temperatures are used to test the attenuated phenotype of the virus. For example, an attenuated virus is able to grow at 35° C., but not at 39° C. or 40° C. In certain embodiments, different cell lines can be used to evaluate the attenuated phenotype of the virus. For example, an attenuated virus may only be able to grow in monkey cell lines but not the human cell lines, or the achievable virus titers in different cell lines are different for the attenuated virus. In certain embodiments, viral replication in the respiratory tract of a small animal model, including but not limited to, hamsters, cotton rats, mice and guinea pigs, is used to evaluate the attenuated phenotypes of the virus. In other embodiments, the immune response induced by the virus, including but not limited to, the antibody titers (e.g., assayed by plaque reduction neutralization assay or ELISA) is used to evaluate the attenuated phenotypes of the virus. In a specific embodiment, the plaque reduction neutralization assay or ELISA is carried out at a low dose. In certain embodiments, the ability of the hSARS virus to elicit pathological symptoms in an animal model can be tested. A reduced ability of the virus to elicit pathological symptoms in an animal model system is indicative of its attenuated phenotype. In a specific embodiment, the candidate viruses are tested in a monkey model for nasal infection, indicated by mucous production.

The viruses of the invention can be attenuated such that one or more of the functional characteristics of the virus are impaired. In certain embodiments, attenuation is measured in comparison to the wild type strain of the virus from which the attenuated virus is derived. In other embodiments, attenuation is determined by comparing the growth of an attenuated virus in different host systems. Thus, for a non-limiting example, hSARS virus or a variant thereof is said to be attenuated when grown in a human host if the growth of the hSARS or variant thereof in the human host is reduced compared to the non-attenuated hSARS or variant thereof.

In certain embodiments, the attenuated virus of the invention is capable of infecting a host, is capable of replicating in a host such that infectious viral particles are produced. In comparison to the wild type strain, however, the attenuated strain grows to lower titers or grows more slowly. Any technique known to the skilled artisan can be used to determine the growth curve of the attenuated virus and compare it to the growth curve of the wild type virus.

In certain embodiments, the attenuated virus of the invention (e.g., a recombinant or chimeric hSARS) cannot replicate in human cells as well as the wild type virus (e.g., wild type hSARS) does. However, the attenuated virus can replicate well in a cell line that lack interferon functions, such as Vero cells.

In other embodiments, the attenuated virus of the invention is capable of infecting a host, of replicating in the host, and of causing proteins of the virus of the invention to be inserted into the cytoplasmic membrane, but the attenuated virus does not cause the host to produce new infectious viral particles. In certain embodiments, the attenuated virus infects the host, replicates in the host, and causes viral proteins to be inserted in the cytoplasmic membrane of the host with the same efficiency as the wild type hSARS. In other embodiments, the ability of the attenuated virus to cause viral proteins to be inserted into the cytoplasmic membrane into the host cell is reduced compared to the wild type virus. In certain embodiments, the ability of the attenuated hSARS virus to replicate in the host is reduced compared to the wild type virus. Any technique known to the skilled artisan can be used to determine whether a virus is capable of infecting a mammalian cell, of replicating within the host, and of causing viral proteins to be inserted into the cytoplasmic membrane of the host.

In certain embodiments, the attenuated virus of the invention is capable of infecting a host. In contrast to the wild type hSARS, however, the attenuated hSARS cannot be replicated in the host. In a specific embodiment, the attenuated hSARS virus can infect a host and can cause the host to insert viral proteins in its cytoplasmic membranes, but the attenuated virus is incapable of being replicated in the host. Any method known to the skilled artisan can be used to test whether the attenuated hSARS has infected the host and has caused the host to insert viral proteins in its cytoplasmic membranes.

In certain embodiments, the ability of the attenuated virus to infect a host is reduced compared to the ability of the wild type virus to infect the same host. Any technique known to the skilled artisan can be used to determine whether a virus is capable of infecting a host.

In certain embodiments, mutations (e.g., missense mutations) are introduced into the genome of the virus, for example, into the sequence of SEQ ID NO:1, 11, 13, 15, 2471 or 2473, or to generate a virus with an attenuated phenotype. Mutations (e.g., missense mutations) can be introduced into the structural genes and/or regulatory genes of the hSARS. Mutations can be additions, substitutions, deletions, or combinations thereof. Such variant of hSARS can be screened for a predicted functionality, such as infectivity, replication ability, protein synthesis ability, assembling ability, as well as cytopathic effect in cell cultures. In a specific embodiment, the missense mutation is a cold-sensitive mutation. In another embodiment, the missense mutation is a heat-sensitive mutation. In another embodiment, the missense mutation prevents a normal processing or cleavage of the viral proteins.

In other embodiments, deletions are introduced into the genome of the hSARS virus, which result in the attenuation of the virus.

In certain embodiments, attenuation of the virus is achieved by replacing a gene of the wild type virus with a gene of a virus of a different species, of a different subgroup, or of a different variant. In another aspect, attenuation of the virus is achieved by replacing one or more specific domains of a protein of the wild type virus with domains derived from the corresponding protein of a virus of a different species. In certain other embodiments, attenuation of the virus is achieved by deleting one or more specific domains of a protein of the wild type virus.

When a live attenuated vaccine is used, its safety must also be considered. The vaccine must not cause disease. Any techniques known in the art that can make a vaccine safe may be used in the present invention. In addition to attenuation techniques, other techniques may be used. One non-limiting example is to use a soluble heterologous gene that cannot be incorporated into the virion membrane. For example, a single copy of the soluble version of a viral transmembrane protein lacking the transmembrane and cytosolic domains thereof, can be used.

Various assays can be used to test the safety of a vaccine. For example, sucrose gradients and neutralization assays can be used to test the safety. A sucrose gradient assay can be used to determine whether a heterologous protein is inserted in a virion. If the heterologous protein is inserted in the virion, the virion should be tested for its ability to cause symptoms in an appropriate animal model since the virus may have acquired new, possibly pathological, properties.

5.4 Adjuvants and Carrier Molecules hSARS-associated antigens are administered with one or more adjuvants. In one embodiment, the hSARS-associated antigen is administered together with a mineral salt adjuvants or mineral salt gel adjuvant. Such mineral salt and mineral salt gel adjuvants include, but are not limited to, aluminum hydroxide (ALHYDROGEL, REHYDRAGEL), aluminum phosphate gel, aluminum hydroxyphosphate (ADJU-PHOS), and calcium phosphate.

In another embodiment, hSARS-associated antigen is administered with an immunostimulatory adjuvant. Such class of adjuvants, include, but are not limited to, cytokines (e.g., interleukin-2, interleukin-7, interleukin-12, granulocyte-macrophage colony stimulating factor (GM-CSF), interferon-γ-interleukin-1β (IL-1β), and IL-1β peptide or Sclavo Peptide), cytokine-containing liposomes, triterpenoid glycosides or saponins (e.g., QuilA and QS-21, also sold under the trademark STIMULON, ISCOPREP), Muramyl Dipeptide (MDP) derivatives, such as N-acetyl-muramyl-L-threonyl-D-isoglutamine (Threonyl-MDP, sold under the trademark TERMURTIDE), GMDP, N-acetyl-nor-muramyl-L-alanyl-D-isoglutamnine, N-acetylmuramyl-L-alanyl-D-isoglutaminyl-L-alanine-2-(1'-2'-dipalmitoyl-sn-glycero-3-hydroxy phosphoryloxy)-ethylamine, muramyl tripeptide phosphatidylethanolamine (MTP-PE), unmethylated CpG dinucleotides and oligonucleotides, such as bacterial DNA and fragments thereof, LPS, monophosphoryl Lipid A (3D-MLA sold under the trademark MPL), and polyphosphazenes.

In another embodiment, the adjuvant used is a particular adjuvant, including, but not limited to, emulsions, e.g., Freund's Complete Adjuvant, Freund's Incomplete Adjuvant, squalene or squalane oil-in-water adjuvant formulations, such as SAF and MF59, e.g., prepared with block-copolymers, such as L-121 (polyoxypropylene/polyoxyetheylene) sold under the trademark PLURONIC L-121, Liposomes, Virosomes, cochleates, and immune stimulating complex, which is sold under the trademark ISCOM.

In another embodiment, a microparticular adjuvant is used., Microparticulare adjuvants include, but are not limited to biodegradable and biocompatible polyesters, homo- and copolymers of lactic acid (PLA) and glycolic acid (PGA), poly(lactide-co-glycolides) (PLGA) microparticles, polymers that self-associate into particulates (poloxamer particles), soluble polymers (polyphosphazenes), and virus-like particles (VLPs) such as recombinant protein particulates, e.g., hepatitis B surface antigen (HbsAg).

Yet another class of adjuvants that may be used include mucosal adjuvants, including but not limited to heat-labile enterotoxin from *Escherichia coli* (LT), cholera holotoxin (CT) and cholera Toxin B Subunit (CTB) from *Vibrio cholerae,* mutant toxins (e.g., LTK63 and LTR72), microparticles, and polymerized liposomes.

In other embodiments, any of the above classes of adjuvants may be used in combination with each other or with other adjuvants. For example, non-limiting examples of combination adjuvant preparations that can be used to administer the hSARS-associated antigens of the invention include liposomes containing immunostimulatory protein, cytokines, or T-cell and/or B-cell peptides, or microbes with or without entrapped IL-2 or microparticles containing enterotoxin. Other adjuvants known in the art are also included within the scope of the invention (see *Vaccine Design: The Subunit and Adjuvant Approach,* Chap. 7, Michael F. Powell and Mark J. Newman (eds.), Plenum Press, New York, 1995, which is incorporated herein in its entirety).

The effectiveness of an adjuvant may be determined by measuring the induction of antibodies directed against an immunogenic polypeptide containing a hSARS polypeptide epitope, the antibodies resulting from administration of this polypeptide in vaccines which are also comprised of the various adjuvants.

The polypeptides may be formulated into the vaccine as neutral or salt forms. Pharmaceutically acceptable salts include the acid additional salts (formed with free amino groups of the peptide) and which are formed with inorganic acids, such as, for example, hydrochloric or phosphoric acids, or organic acids such as acetic, oxalic, tartaric, maleic, and the like. Salts formed with free carboxyl groups may also be derived from inorganic bases, such as, for example, sodium potassium, ammonium, calcium, or ferric hydroxides, and such organic bases as isopropylamine, trimethylamine, 2-ethylamino ethanol, histidine, procaine and the like.

The vaccines of the invention may be multivalent or univalent. Multivalent vaccines are made from recombinant viruses that direct the expression of more than one antigen.

Many methods may be used to introduce the vaccine formulations of the invention; these include but are not limited to oral, intradermal, intramuscular, intraperitoneal, intravenous, subcutaneous, intranasal routes, and via scarification (scratching through the top layers of skin, e.g., using a bifurcated needle).

The patient to which the vaccine is administered is preferably a mammal, most preferably a human, but can also be a non-human animal including but not limited to cows, horses, sheep, pigs, fowl (e.g., chickens), goats, cats, dogs, hamsters, mice and rats.

5.5 Preparation of Antibodies

Antibodies which specifically recognize a polypeptide of the invention, such as, but not limited to, polypeptides comprising the sequence of SEQ ID NO:2, 12, 14, 2472, 2474, and polypeptides as shown in FIGS. 11 (SEQ ID NOS:17-239, 241-736 and 738-1107) and 12 (SEQ ID NOS:1109-1589, 1591-1964 and 1966-2470), or hSARS epitope or antigen-binding fragments thereof can be used for detecting, screening, and isolating the polypeptide of the invention or fragments thereof, or similar sequences that might encode similar enzymes from the other organisms. For example, in one specific embodiment, an antibody which immunospecifically binds hSARS epitope, or a fragment thereof, can be used for various in vitro detection assays, including enzyme-linked immunosorbent assays (ELISA), radioimmunoassays, Western blot, etc., for the detection of a polypeptide of the invention or, preferably, hSARS, in samples, for example, a biological material, including cells, cell culture media (e.g., bacterial cell culture media, mammalian cell culture media, insect cell culture media, yeast cell culture media, etc.), blood, plasma, serum, tissues, sputum, naseopharyngeal aspirates, etc.

Antibodies specific for a polypeptide of the invention or any epitope of hSARS may be generated by any suitable method known in the art. Polyclonal antibodies to an antigen-of-interest, for example, the hSARS virus from deposit no. CCTCC-V200303, or comprises a nucleotide sequence of SEQ ID NO:15, can be produced by various procedures well known in the art. For example, an antigen can be administered to various host animals including, but not limited to, rabbits, mice, rats, etc., to induce the production of antisera containing polyclonal antibodies specific for the antigen. Various adjuvants may be used to increase the immunological response, depending on the host species, and include but are not limited to, Freund's (complete and incomplete) adjuvant, mineral gels such as aluminum hydroxide, surface active substances such as lysolecithin, pluronic polyols, polyanions, peptides, oil emulsions, keyhole limpet hemocyanins, dinitrophenol, and potentially useful adjuvants for humans such as BCG (Bacille Calmette-Guerin) and *Corynebacterium parvum.* Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas, pp. 563-681 (Elsevier, N.Y., 1981) (both of which are incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art. In a non-limiting example, mice can be immunized with an antigen of interest or a cell expressing such an antigen. Once an immune response is detected, e.g., antibodies specific for the antigen are detected in the mouse serum, the mouse spleen is harvested and splenocytes isolated. The splenocytes are then fused by well known techniques to any suitable myeloma cells. Hybridomas are selected and cloned by limiting dilution. The hybridoma clones are then assayed by methods known in the art for cells that secrete antibodies capable of binding the antigen. Ascites fluid, which generally contains high levels of antibodies, can be generated by inoculating mice intraperitoneally with positive hybridoma clones.

Antibody fragments which recognize specific epitopes may be generated by known techniques. For example, Fab and $F(ab')_2$ fragments may be produced by proteolytic cleavage of immunoglobulin molecules, using enzymes such as papain (to produce Fab fragments) or pepsin (to produce $F(ab')_2$ fragments). $F(ab')_2$ fragments contain the complete light chain, and the variable region, the CH1 region and the hinge region of the heavy chain.

The antibodies of the invention or fragments thereof can be also produced by any method known in the art for the synthesis of antibodies, in particular, by chemical synthesis or preferably, by recombinant expression techniques.

The nucleotide sequence encoding an antibody may be obtained from any information available to those skilled in the art (i.e., from Genbank, the literature, or by routine cloning and sequence analysis). If a clone containing a nucleic acid encoding a particular antibody or an epitope-binding fragment thereof is not available, but the sequence of the antibody molecule or epitope-binding fragment thereof is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from any tissue or cells expressing the antibody, such as hybridoma cells selected to express an antibody) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., supra; and Ausubel et al., eds., 1998, Current Protocols in Molecular Biology, John Wiley & Sons, NY, which are both incorporated by reference herein in their entireties), to generate antibodies having a different amino acid sequence by, for example, introducing amino acid substitutions, deletions, and/or insertions into the epitope-binding domain regions of the antibodies or any portion of antibodies which may enhance or reduce biological activities of the antibodies.

Recombinant expression of an antibody requires construction of an expression vector containing a nucleotide sequence that encodes the antibody. Once a nucleotide sequence encoding an antibody molecule or a heavy or light chain of an antibody, or portion thereof has been obtained, the vector for the production of the antibody molecule may be produced by recombinant DNA technology using techniques well known in the art as discussed in the previous sections. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The nucleotide sequence encoding the heavy-chain variable region, light-chain variable region, both the heavy-chain and light-chain variable regions, an epitope-binding fragment of the heavy- and/or light-chain variable region, or one or more complementarity determining regions (CDRs) of an antibody may be cloned into such a vector for expression. Thus-prepared expression vector can be then introduced into appropriate host cells for the expression of the antibody. Accordingly, the invention includes host cells containing a polynucleotide encoding an antibody specific for the polypeptides of the invention or fragments thereof.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides or different selectable markers to ensure maintenance of both plasmids. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature, 322:52, 1986; and Kohler, Proc. Natl. Acad. Sci. USA, 77:2 197, 1980). The coding sequences for the heavy and light chains may comprise cDNA or genomic DNA.

In another embodiment, antibodies can also be generated using various phage display methods known in the art. In phage display methods, functional antibody domains are displayed on the surface of phage particles which carry the polynucleotide sequences encoding them. In a particular embodiment, such phage can be utilized to display antigen binding domains, such as Fab and Fv or disulfide-bond stabilized Fv, expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage, including fd and M13. The antigen binding domains are expressed as a recombinantly fused protein to either the phage gene III or gene VIII protein. Examples of phage display methods that can be used to make the immunoglobulins, or fragments thereof, of the present invention include those disclosed in Brinkman et al., J. Immunol. Methods, 182:41-50, 1995; Ames et al., J. Immunol. Methods, 184:177-186, 1995; Kettleborough et al., Eur. J. Immunol., 24:952-958, 1994; Persic et al., Gene, 187:9-18, 1997; Burton et al., Advances in Immunology, 57:191-280, 1994; PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired fragments, and expressed in any desired host, including mammalian cells, insect cells, plant cells, yeast, and bacteria, e.g., as described in detail below. For example, techniques to recombinantly produce Fab, Fab' and F(ab)$_2$ fragments can also be employed using methods known in the art such as those disclosed in PCT publication WO 92/22324; Mullinax et al., BioTechniques, 12(6):864-869, 1992; and Sawai et al., AJRI, 34:26-34, 1995; and Better et al., Science, 240:1041-1043, 1988 (each of which is incorporated by reference in its entirety). Examples of techniques which can be used to produce single-chain Fvs and antibodies include those described in U.S. Pat. Nos. 4,946,778 and 5,258,498; Huston et al., Methods in Enzymology, 203:46-88, 1991; Shu et al., PNAS, 90:7995-7999, 1993; and Skerra et al., Science, 240:1038-1040, 1988.

Once an antibody molecule of the invention has been produced by any methods described above, it may then be purified by any method known in the art for purification of an immunoglobulin molecule, for example, by chromatography (e.g., ion exchange, affinity, particularly by affinity for the specific antigen after Protein A or Protein G purification, and sizing column chromatography), centrifugation, differential solubility, or by any other standard techniques for the purification of proteins. Further, the antibodies of the present invention or fragments thereof may be fused to heterologous polypeptide sequences described herein or otherwise known in the art to facilitate purification.

For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a constant region derived from a human immunoglobulin. Methods for producing chimeric antibodies are known in the art. See e.g., Morrison, Science, 229:1202, 1985; Oi et al., BioTechniques, 4:214 1986; Gillies et al., J. Immunol. Methods, 125:191-202, 1989; U.S. Pat. Nos. 5,807,715; 4,816,567; and 4,816,397, which are incorporated herein by reference in their entireties. Humanized antibodies are antibody molecules from non-human species that bind the desired antigen having one or more complementarity determining regions (CDRs) from the non-human species and framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332:323, 1988, which are incorporated herein by reference in their entireties. Antibodies can be humanized using a variety of techniques known in the art including, for example, CDR-grafting (EP 239,400; PCT publication WO 91/09967; U.S. Pat. Nos. 5,225,539; 5,530,101 and 5,585,089), veneering or resurfacing (EP 592,106; EP 519,596; Padlan, Molecular Immunology, 28(4/5):489-498, 1991; Studnicka et al., Protein Engineering, 7(6):805-814, 1994; Roguska et al., Proc Natl. Acad. Sci. USA, 91:969-973, 1994), and chain shuffling (U.S. Pat. No. 5,565,332), all of which are hereby incorporated by reference in their entireties.

Completely human antibodies are particularly desirable for therapeutic treatment of human patients. Human antibodies can be made by a variety of methods known in the art including phage display methods described above using antibody libraries derived from human immunoglobulin sequences. See U.S. Pat. Nos. 4,444,887 and 4,716,111; and PCT publications WO 98/46645; WO 98/50433; WO 98/24893; WO 98/16654; WO 96/34096; WO 96/33735; and WO 91/10741, each of which is incorporated herein by reference in its entirety.

Human antibodies can also be produced using transgenic mice which are incapable of expressing functional endogenous immunoglobulins, but which can express human immunoglobulin genes. For an overview of this technology for producing human antibodies, see Lonberg and Huszar, Int. Rev. Immunol., 13:65-93, 1995. For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598, which are incorporated by reference herein in their entireties. In addition, companies such as Abgenix, Inc. (Fremont, Calif.), Medarex (NJ) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology, 12:899-903, 1988).

Antibodies fused or conjugated to heterologous polypeptides may be used in in vitro immunoassays and in purification methods (e.g., affinity chromatography) well known in the art. See e.g., PCT publication Number WO 93/21232; EP 439,095; Naramura et al., Immunol. Lett., 39:91-99, 1994; U.S. Pat. No. 5,474,981; Gillies et al., PNAS, 89:1428-1432, 1992; and Fell et al., J. Immunol., 146:2446-2452, 1991, which are incorporated herein by reference in their entireties.

Antibodies may also be attached to solid supports, which are particularly useful for immunoassays or purification of the polypeptides of the invention or fragments, derivatives, analogs, or variants thereof, or similar molecules having the similar enzymatic activities as the polypeptide of the invention. Such solid supports include, but are not limited to, glass, cellulose, polyacrylamide, nylon, polystyrene, polyvinyl chloride or polypropylene.

5.6 Pharmaceutical Compositions and Kits

The present invention encompasses pharmaceutical compositions comprising anti-viral agents of the present invention. In a specific embodiment, the anti-viral agent is an antibody which immunospecifically binds and neutralize the hSARS virus or variants thereof, or any proteins derived therefrom. In another specific embodiment, the anti-viral agent is a polypeptide or nucleic acid molecule of the invention. The pharmaceutical compositions have utility as an anti-viral prophylactic agent and may be administered to a subject where the subject has been exposed or is expected to be exposed to a virus.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu and Wu, 1987, J. Biol. Chem. 262:4429 4432). Methods of introduction include but are not limited to intradermal, intramuscular, intraperitoneal, intravenous, subcutaneous, intranasal, epidural, and oral routes. The compounds may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In a preferred embodiment, it may be desirable to introduce the pharmaceutical compositions of the invention into the lungs by any suitable route. Pulmonary administration can also be employed, e.g., by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non porous, or gelatinous material, including membranes, such as sialastic membranes, or fibers. In one embodiment, administration can be by direct injection at the site (or former site) infected tissues.

In another embodiment, the pharmaceutical composition can be delivered in a vesicle, in particular a liposome (see Langer, 1990, Science 249:1527-1533; Treat et al., in Liposomes in the Therapy of Infectious Disease and Cancer, Lopez Berestein and Fidler (eds.), Liss, New York, pp. 353-365 (1989); Lopez-Berestein, ibid., pp. 317-327; see generally ibid.).

In yet another embodiment, the pharmaceutical composition can be delivered in a controlled release system. In one embodiment, a pump may be used (see Langer, supra; Sefton, 1987, CRC Crit. Ref. Biomed. Eng. 14:201; Buchwald et al.,1980, Surgery 88:507; and Saudek et al., 1989, N. Engl. J. Med. 321:574). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, N.Y. (1984); Ranger and Peppas, J. Macromol. Sci. Rev. Macromol. Chem. 23:61 (1983); see also Levy et al., 1985, Science 228:190; During et al., 1989, Ann. Neurol. 25:351; Howard et al., 1989, J. Neurosurg. 71:105). In yet another embodiment, a controlled release system can be placed in proximity of the composition's target, i.e., the lung, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

The pharmaceutical compositions of the present invention comprise a therapeutically effective amount of an live attenuated, inactivated or killed hSARS virus, or recombinant or chimeric hSARS virus, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the pharmaceutical composition is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The pharmaceutical compositions of the invention can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2 ethylamino ethanol, histidine, procaine, etc.

The amount of the pharmaceutical composition of the invention which will be effective in the treatment of a particular disorder or condition will depend on the nature of the disorder or condition, and can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. However, suitable dosage ranges for intravenous administration are generally about 20 500 micrograms of active compound per kilogram body weight. Suitable dosage ranges for intranasal administration are generally about 0.01 pg/kg body weight to 1 mg/kg body weight. Effective doses may be extrapolated from dose response curves derived from in vitro or animal model test systems.

Suppositories generally contain active ingredient in the range of 0.5% to 10% by weight; oral formulations preferably contain 10% to 95% active ingredient.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration. In a preferred embodiment, the kit contains an anti-viral agent of the invention, e.g., an antibody specific for the polypeptides encoded by a nucleotide sequence of SEQ ID NO:1, 11, 13, 15, 2471 or 2473, or as shown in FIGS. 11 (SEQ ID NOS:17-239, 241-736 and 738-1107) and 12 (SEQ ID NOS: 1109-1589, 1591-1964 and 1966-2470), or any hSARS epitope, or a polypeptide or protein of the present invention, or a nucleic acid molecule of the invention, alone or in combination with adjuvants, antivirals, antibiotics, analgesic, bronchodialaters, or other pharmaceutically acceptable excipients.

The present invention further encompasses kits comprising a container containing a pharmaceutical composition of the present invention and instructions to for use.

5.7 Detection Assays

The present invention provides a method for detecting an antibody, which immunospecifically binds to the hSARS virus, in a biological sample, for example blood, serum, plasma, saliva, urine, etc., from a patient suffering from SARS. In a specific embodiment, the method comprising contacting the sample with the hSARS virus, for example, of deposit no. CCTCC-V200303, or having a genomic nucleic acid sequence of SEQ ID NO:15, directly immobilized on a substrate and detecting the virus-bound antibody directly or indirectly by a labeled heterologous anti-isotype antibody. In another specific embodiment, the sample is contacted with a host cell which is infected by the hSARS virus, for example, of deposit no. CCTCC-V200303, or having a genomic nucleic acid sequence of SEQ ID NO:15, and the bound antibody can be detected by immunofluorescent assay as described in Section 6.5, infra.

An exemplary method for detecting the presence or absence of a polypeptide or nucleic acid of the invention in a biological sample involves obtaining a biological sample from various sources and contacting the sample with a compound or an agent capable of detecting an epitope or nucleic acid (e.g., mRNA, genomic RNA) of the hSARS virus such that the presence of the hSARS virus is detected in the sample. A preferred agent for detecting hSARS mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence or SEQ ID NO:1, 11, 13, 15, 2471, or 2473, or a portion thereof, such as an oligonucleotide of at least 15, 20, 25, 30, 50, 100, 250, 500, 750, 1,000 or more contiguous nucleotides in length and sufficient to specifically hybridize under stringent conditions to a hSARS mRNA or genomic RNA.

In another preferred specific embodiment, the presence of hSARS virus is detected in the sample by an reverse transcription polymerase chain reaction (RT-PCR) using the primers that are constructed based on a partial nucleotide sequence of the genome of hSARS virus, for example, that of deposit accession no. CCTCC-V200303, or having a genomic nucleic acid sequence of SEQ ID NO:15, or based on a nucleotide sequence of SEQ ID NO:1, 11, 13, 2471 or 2473. In a non-limiting specific embodiment, preferred primers to be used in a RT-PCR method are: 5'-TACACACCTCAGC-GTTG-3' (SEQ ID NO:3) and 5'-CACGAACGTGACG-AAT-3' (SEQ ID NO:4), in the presence of 2.5 mM MgCl$_2$ and the thermal cycles are, for example, but not limited to, 94° C. for 8 min followed by 40 cycles of 94° C. for 1 min, 50° C. for 1 min, 72° C. for 1 min (also see Sections 6.7 and 6.8 infra). In preferred embodiments, the primers comprise nucleic acid sequence of SEQ ID NOS:2475 and 2476, or SEQ ID NOS: 2480 and 2481. In preferred embodiments, the thermal cycles are 94° C. for 10 min followed by 40 cycles of 94° C. for 30 seconds, 56° C. for 30 seconds, 72° C. for 30 seconds, 72° C. for 10 minutes. In preferred embodiments, the primers comprise nucleic acid sequence of SEQ ID NOS:2477 and 2478. In more preferred specific embodiment, the present invention provides a real-time quantitative PCR assay to detect the presence of hSARS virus in a biological sample by subjecting the cDNA obtained by reverse transcription of the extracted total RNA from the sample to PCR reactions using the specific primers, such as those having nucleotide sequences of SEQ ID NOS:3 and 4, and a fluorescence dye, such as SYBR® Green I, which fluoresces when bound non-specifically to double-stranded DNA. The fluorescence signals from these reactions are captured at the end of extension steps as PCR product is generated over a range of the thermal cycles, thereby allowing the quantitative determination of the viral load in the sample based on an amplification plot (see Section 6.7, infra).

A preferred agent for detecting hSARS is an antibody that specifically binds a polypeptide of the invention or any hSARS epitope, preferably an antibody with a detectable label. Antibodies can be polyclonal, or more preferably, monoclonal. An intact antibody, or a fragment thereof (e.g., Fab or F(ab')$_2$) can be used.

The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The detection method of the invention can be used to detect mRNA, protein (or any epitope), or genomic RNA in a sample in vitro as well as in vivo. For example, in vitro techniques for detection of mRNA include northern hybridizations, in situ hybridizations, RT-PCR, and RNase protection. In vitro techniques for detection of an epitope of hSARS include enzyme linked immunosorbent assays (ELISAs), Western blots, immunoprecipitations and immunofluorescence. In vitro techniques for detection of genomic RNA include nothern hybridizations, RT-PCT, and RNase protection. Furthermore, in vivo techniques for detection of hSARS include introducing into a subject organism a labeled antibody directed against the polypeptide. For example, the antibody can be labeled with a radioactive marker whose presence and location in the subject organism can be detected by standard imaging techniques, including autoradiography.

In a specific embodiment, the methods further involve obtaining a control sample from a control subject, contacting the control sample with a compound or agent capable of detecting hSARS, e.g., a polypeptide of the invention or mRNA or genomic RNA encoding a polypeptide of the invention, such that the presence of hSARS or the polypeptide or mRNA or genomic RNA encoding the polypeptide is detected in the sample, and comparing the presence of hSARS or the polypeptide or mRNA or genomic RNA encoding the polypeptide in the control sample with the presence of hSARS, or the polypeptide or mRNA or genomic DNA encoding the polypeptide in the test sample.

The invention also encompasses kits for detecting the presence of hSARS or a polypeptide or nucleic acid of the invention in a test sample. The kit, for example, can comprise a labeled compound or agent capable of detecting hSARS or the polypeptide or a nucleic acid molecule encoding the polypeptide in a test sample and, in certain embodiments, a means for determining the amount of the polypeptide or mRNA in the sample (e.g., an antibody which binds the polypeptide or an oligonucleotide probe which binds to DNA or mRNA encoding the polypeptide). Kits can also include instructions for use.

For antibody-based kits, the kit can comprise, for example: (1) a first antibody (e.g., attached to a solid support) which binds to a polypeptide of the invention or hSARS epitope; and, optionally, (2) a second, different antibody which binds to either the polypeptide or the first antibody and is conjugated to a detectable agent.

For oligonucleotide-based kits, the kit can comprise, for example: (1) an oligonucleotide, e.g., a detectably labeled oligonucleotide, which hybridizes to a nucleic acid sequence encoding a polypeptide of the invention or to a sequence within the hSARS genome or (2) a pair of primers useful for amplifying a nucleic acid molecule containing an hSARS sequence. The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples which can be assayed and compared to the test sample contained. Each component of the kit is usually enclosed within an individual container and all of the various containers are within a single package along with instructions for use.

5.8 Screening Assays to Identify Anti-Viral Agents

The invention provides methods for the identification of a compound that inhibits the ability of hSARS virus to infect a host or a host cell. In certain embodiments, the invention provides methods for the identification of a compound that reduces the ability of hSARS virus to replicate in a host or a host cell. Any technique well-known to the skilled artisan can be used to screen for a compound that would abolish or reduce the ability of hSARS virus to infect a host and/or to replicate in a host or a host cell.

In certain embodiments, the invention provides methods for the identification of a compound that inhibits the ability of hSARS virus to replicate in a mammal or a mammalian cell. More specifically, the invention provides methods for the identification of a compound that inhibits the ability of hSARS virus to infect a mammal or a mammalian cell. In certain embodiments, the invention provides methods for the identification of a compound that inhibits the ability of hSARS virus to replicate in a mammalian cell. In a specific embodiment, the mammalian cell is a human cell.

In another embodiment, a cell is contacted with a test compound and infected with the hSARS virus. In certain embodiments, a control culture is infected with the hSARS virus in the absence of a test compound. The cell can be contacted with a test compound before, concurrently with, or subsequent to the infection with the hSARS virus. In a specific embodiment, the cell is a mammalian cell. In an even more specific embodiment, the cell is a human cell. In certain embodiments, the cell is incubated with the test compound for at least 1 minute, at least 5 minutes at least 15 minutes, at least 30 minutes, at least 1 hour, at least 2 hours, at least 5 hours, at least 12 hours, or at least 1 day. The titer of the virus can be measured at any time during the assay. In certain embodiments, a time course of viral growth in the culture is determined. If the viral growth is inhibited or reduced in the presence of the test compound, the test compound is identified as being effective in inhibiting or reducing the growth or infection of the hSARS virus. In a specific embodiment, the compound that inhibits or reduces the growth of the hSARS virus is tested for its ability to inhibit or reduce the growth rate of other viruses to test its specificity for the hSARS virus.

In one embodiment, a test compound is administered to a model animal and the model animal is infected with the hSARS virus. In certain embodiments, a control model animal is infected with the hSARS virus without the administration of a test compound. The test compound can be administered before, concurrently with, or subsequent to the infection with the hSARS virus. In a specific embodiment, the model animal is a mammal. In an even more specific embodiment, the model animal can be, but is not limited to, a cotton rat, a mouse, or a monkey. The titer of the virus in the model animal can be measured at any time during the assay. In certain embodiments, a time course of viral growth in the culture is determined. If the viral growth is inhibited or reduced in the presence of the test compound, the test compound is identified as being effective in inhibiting or reducing the growth or infection of the hSARS virus. In a specific embodiment, the compound that inhibits or reduces the growth of the hSARS in the model animal is tested for its ability to inhibit or reduce the growth rate of other viruses to test its specificity for the hSARS virus.

6. EXAMPLES

The following examples illustrate the isolation and identification of the novel hSARS virus. These examples should not be construed as limiting.

Methods and Results

As a general reference, Wiedbrauk D I & Johnston S L G. (Manual of Clinical Virology, Raven Press, New York, 1993) was used.

6.1 Clinical Subjects

The study included all 50 patients who fitted a modified World Health Organization (WHO) definition of SARS and were admitted to 2 acute regional hospitals in Hong Kong Special Administrative Region (HKSAR) between Feb. 26 to Mar. 26, 2003 (WHO. Severe acute respiratory syndrome (SARS) *Weekly Epidemiol Rec.* 2003; 78: 81-83). A lung biopsy from an additional patient, who had typical SARS and was admitted to a third hospital, was also included in the study. Briefly, the case definition for SARS was: (i) fever of 38° C. or more; (ii) cough or shortness of breath; (iii) new pulmonary infiltrates on chest radiograph; and (iv) either a history of exposure to a patient with SARS or absence of response to empirical antimicrobial coverage for typical and atypical pneumonia (beta-lactams and macrolides, fluoroquinolones or tetracyclines).

Nasopharyngeal aspirates and serum samples were collected from all patients. Paired acute and convalescent sera and feces were available from some patients. Lung biopsy tissue from one patient was processed for a viral culture, RT-PCR, routine histopathological examination, and electron microscopy. Nasopharyngeal aspirates, feces and sera submitted for microbiological investigation of other diseases were included in the study under blinding and served as controls.

The medical records were reviewed retrospectively by the attending physicians and clinical microbiologists. Routine hematological, biochemical and microbiological examinations, including bacterial culture of blood and sputum, serological study and collection of nasopharyngeal aspirates for virological tests, were carried out.

6.2 Cell Line

FRhK-4 (fetal rhesus monkey kidney) cells were maintained in minimal essential medium (MEM) with 1% fetal calf serum, 1% streptomycin and penicillin, 0.2% nystatin and 0.05% garamycin.

6.3 Viral Infection

Two-hundred µl of clinical (nasopharyngeal aspirates) samples, from two patients (see the Result section, infra), in virus transport medium were used to infect FRhk-4 cells. The inoculated cells were incubated at 37° C. for 1 hour. One ml of MEM containing 1 µg trypsin was then added to the culture and the infected cells were incubated in a 37° C. incubator supplied with 5% carbon dioxide. Cytopathic effects were observed in the infected cells after 2 to 4 days of incubation. The infected cells were passaged into new FRhK-4 cells and cytopathic effects were observed within 1 day after the inoculation. The infected cells were tested by an immunofluorescent assay for influenza A., influenza B, respiratory syncytial virus, parainfluenza types 1, 2 and 3, adenovirus and human metapneumovirus (hMPV) and negative results were obtained for all cases. The infected cells were also tested by RT-PCR for influenza A and human metapneumovirus with negative results.

6.4 Virus Morphology

The infected cells prepared as described above were harvested, pelleted by centrifugation and the cell pellets were processed for thin-section transmitted electron microscopic visualization. Viral particles were identified in the cells infected with both clinical specimens, but not in control cells which were not infected with the virus. Virions isolated from the infected cells were about 70-100 nanometers (FIG. 2). Viral capsids were found predominantly within the vesicles of the golgi and endoplasmic reticulum and were not free in the cytoplasm. Virus particles were also found at the cell membrane.

One virus isolate was ultracentrifuged and the cell pellet was negatively stained using phosphotugstic acid. Virus particles characteristic of Coronaviridae were thus visualized. Since the human Coronaviruses hitherto recognized are not known to cause a similar disease, the present inventors postulated that the virus isolates represent a novel virus that infects humans.

6.5 Antibody Response to the Isolated Virus

To further confirm that this novel virus is responsible for causing SARS in the infected patients, blood serum samples from the patients who were suffering from SARS were obtained and a neutralization test was performed. Typically diluted serum (×50, ×200, ×800 and ×1600) was incubated with acetone-fixed FRhK-4 cells infected with hSARS at 37° C. for 45 minutes. The incubated cells were then washed with phosphate-buffered saline and stained with anti-human IgG-FITC conjugated antibody. The cells were then washed and examined under a fluorescent microscope. In these experiments, positive signals were found in 8 patients who had SARS (FIG. 3), indicating that these patients had an IgG antibody response to this novel human respiratory virus of Coronaviridae. By contrast, no signal was detected in 4 negative-control paired sera. The serum titers of anti-hSARS antibodies of the tested patients are shown in Table 1.

TABLE 1

| Name | Date | Lab No. | Anti-SARS |
|---|---|---|---|
| Patient A | 25 Feb. 2003 | S2728 | <50 |
|  | 6 Mar. 2003 | S2728 | 1600 |
| Patient B | 26 Feb. 2003 | S2441 | 50 |
|  | 3 Mar. 2003 | S2441 | 200 |
| Patient C | 4 Mar. 2003 | S3279 | 200 |
|  | 14 Mar. 2003 | S3279 | 1600 |
| Patient D | 6 Mar. 2003 | M41045 | <50 |
|  | 11 Mar. 2003 | MB943703 | 800 |
| Patient E | 4 Mar. 2003 | M38953 | <50 |
|  | 18 Mar 2003 | KWH03/3601 | 800 |
| Control F | 13 Feb. 2003 | M27124 | <50 |
|  | 1 Mar. 2003 | MB942968 | <50 |
| Patient G | 3 Mar. 2003 | M38685 | <50 |
|  | 7 Mar. 2003 | KWH03/2900 | Equivocal |
| Blinded samples: | | | |
| 1a * | Acute |  | <50 |
| 1b | Convalescent |  | 1600 |
| 2a * | Acute |  | 50 |
| 2b | Convalescent |  | >1600 |
| 3a * | Acute |  | 50 |
| 3b | Convalescent |  | >1600 |
| 4a * | Acute |  | <50 |
| 4b | Convalescent |  | <50 |
| 5a * | Acute |  | <50 |
| 5b | Convaelscent |  | <50 |
| 6a * | Acute |  | <50 |
| 6b | Convalescent |  | <50 |

NB: * patients with SARS
These results indicated that this novel member of Coronaviridae is a key pathogen in SARS.

6.6 Sequences of the hSARS Virus

Total RNA from infected or uninfected FrHK-4 cells was harvested two days post-infection. One-hundred ng of purified RNA was reverse transcribed using Superscript II reverse transcriptase (Invitrogen) in a 20 µl reaction mixture containing 10 pg of a degenerated primer (5'-GCCG-GAGCTCTGCAGAATTCNNNNNNN-3', N=A, T, G or C: SEQ ID NO:5) as recommended by the manufacturer. Reverse transcribed products were then purified by a QIAquick PCR purification kit as instructed by the manufacturer and eluted in 30 µl of 10 mM Tris-HCl, pH 8.0. Three µl of purified cDNA products were add in a 25 µl reaction mixture containing 2.5 µl of 10×PCR buffer, 4 µl of 25 mM $MgCl_2$, 0.5 µl of 10 mM dNTP, 0.25 µl of AmpliTaq Gold® DNA polymerase (Applied Biosystems), 2.5 µCi of [$\alpha$-$^{32}$P] CTP (Amersham), 2 µl of 10 µM primer (5'-GCCG-GAGCTCTGCAGAATT-C-3': SEQ ID NO:6). Reactions were thermal cycled through the following profile: 94° C. for 8 min followed by 2 cycles of 94° C. for 1 min, 40° C. for 1 min, 72° C. for 2 min. This temperature profile was followed by 35 cycles of 94° C. for 1 min, 60° C. for 1 min, 72° C. for 1 min. 6 µl of the PCR products were analyzed in a 5% denaturing polyacrylamide gel electrophoresis. Gel was exposed to X-ray film and the film was developed after an over-night exposure. Unique PCR products which were only identified in infected cell samples were isolated from the gel and eluted in a 50 µl of 1×TE buffer. Eluted PCR products were then re-amplified in 25 µl of reaction mixture containing 2.5 µl of 10×PCR buffer, 4 µl of 25 mM MgCl$_2$, 0.5 µl ru 10 mM dNTP, 0.25 µl of AmpliTaq Gold® DNA polymerase (Applied Biosystems), 1 µl of 10 µM primer (5'-GCCG-GAGCTCTGCAGAATTC-3':SEQ ID NO:6). Reaction mixtures were thermal cycled through the following profile: 94° C. for 8 min followed by 35 cycles of 94° C. for 1 min, 60° C. for 1 min, 72° C. for 1 min. PCR products were cloned using a TOPO TA cloning kit (Invitrogen) and ligated plasmids were transformed into TOP10 E. coli competent cells (Invitrogen). PCR inserts were sequenced by a BigDye cycle sequencing kit as recommended by the manufacturer (Applied Biosystems) and sequencing products were analyzed by an automatic sequencer (Applied Biosystems, model number 3770). The obtained sequence (SEQ ID NO:1) is shown in FIG. 1. The deducted amino acid sequence (SEQ ID NO:2) from the obtained DNA sequence showed 57% homology to the polymerase protein of identified coronaviruses.

Similarly, two other partial sequences (SEQ ID NOS:11 and 13) and deduced amino acid sequences (SEQ ID NOS:12 and 14, respectively) were obtained from the hSARS virus and are shown in FIGS. 8 (SEQ ID NOS:11 and 12) and 9 (SEQ ID NOS:13 and 14).

The entire genomic sequence of hSARS virus is shown in FIG. 10 (SEQ ID NO:15). The deduced amino acid sequences of SEQ ID NO:15 in all three frames (SEQ ID NO:16, 240 and 737) are shown in FIG. 11 (SEQ ID NOS:17-239, 241-736 and 738-1107). The deduced amino acid sequences of the complement of SEQ ID NO:15 in all three frames (SEQ ID NOS:1108, 1590 and 1965) are shown in FIG. 12 (SEQ ID NOS:1109-1589, 1591-1964 and 1966-2470).

6.7 Detection of hSARS Virus in Nasopharyngeal Aspirates

First, the nasopharyngeal aspirates (NPA) were examined by rapid immunoflourescent antigen detection for influenza A and B, parainfluenza types 1, 2 and 3, respiratory syncytial virus and adenovirus (Chan K H, Maldeis N, Pope W, Yup A, Ozinskas A. Gill J, Seto W H, Shortridge K F, Peiris J S M. Evaluation of Directigen Fly A+B test for rapid diagnosis of influenza A and B virus infections. *J Clin Microbiol.* 2002; 40: 1675-1680) and were cultured for conventional respiratory pathogens on Mardin Darby Canine Kidney, LLC-Mk2, RDE, Hep-2 and MRC-5 cells (Wiedbrauk D L, Johnston S L G. *Manual of clinical virology.* Raven Press, New York. 1993). Subsequently, fetal rhesus kidney (FRhk-4) and A-549 cells were added to the panel of cell lines used. Reverse transcription polymerase chain reaction (RT-PCR) was performed directly on the clinical specimen for influenza A (Fouchier R A, Bestebroer T M, Herfst S, Van Der Kemp L, Rimmelzwan G F, Osterhaus A D. Detection of influenza A virus from different species by PCR amplification of conserved sequences in the matrix gene. *J Clin Microbiol.* 2000; 38: 4096-101) and human metapneumovirus (HMPV). The primers used for HMPV were: for first round, 5'-AARGT-SAATGCATCAGC-3' (SEQ ID NO. 7) and 5'-CAKATTYT-GCTTATGCTTTC-3' (SEQ ID NO:8); and nested primers: 5'-ACACCTGTTACAATACCAGC-3' (SEQ ID NO:9) and 5'-GACTTGAGTCCCAGCTCCA-3' (SEQ ID NO:10). The size of the nested PCR product was 201 bp. An ELISA for mycoplasma was used to screen cell cultures (Roche Diagnostics GmbH, Roche, Indianapolis, USA).

RT-PCR Assay

Subsequent to culturing and genetic sequencing of the hSARS virus from two patients (see Section 6.6, supra), an RT-PCR was developed to detect the hSARS virus sequence from NPA samples. Total RNA from clinical samples was reverse transcribed using random hexamers and cDNA was amplified using primers 5'-TACACACCTCAGC-GTTG-3' (SEQ ID NO:3) and 5'-CACGAACGTGACGAAT-3' (SEQ ID NO:4), which are constructed based on the in the presence of 2.5 mM MgCl$_2$ (94° C. for 8 min followed by 40 cycles of 94° C. for 1 min, 50° C. for 1 min, 72° C. for 1 min).

The summary of a typical RT-PCR protocol is as follows:

1. RNA Extraction

RNA from 140 µl of NPA samples is extracted by QIAquick viral RNA extraction kit and is eluted in 50 µl of elution buffer.

| RNA | 11.5 µl |
|---|---|
| 0.1 M DTT | 2 µl |
| 5× buffer | 4 µl |
| 10 mM dNTP | 1 µl |
| Superscript II, 200 U/µl (Invitrogen) | 1 µl |
| Random hexamers, 0.3 µg/µl | 0.5 µl |
| Reaction condition | 42° C., 50 min |
| | 94° C., 3 min |
| | 4° C. |

3. PCR cDNA generated by random primers is amplified in a 50 µl reaction as follows:

| cDNA | 2 µl |
|---|---|
| 10 mM dNTP | 0.5 µl |
| 10× buffer | 5 µl |
| 25 mM MgCl$_2$ | 5 µl |
| 25 µM Forward primer | 0.5 µl |
| 25 µM Reverse primer | 0.5 µl |
| AmpliTaq Gold polymerase, 5 U/µl (Applied Biosystems) | 0.25 µl |
| Water | 36.25 µl |

Thermal-cycle condition: 95° C., 10 min, followed by 40 cycles of 95° C., 1 min; 50° C. 1 min; 72° C., 1 min.

4. Primer Sequences

Primers were designed based on the RNA-dependent RNA polymerase encoding sequence (SEQ ID NO:1) of the hSARS virus.

```
Forward primer:
5' TACACACCTCAGCGTTG 3'          (SEQ ID NO:3)

Reverse primer:
5' CACGAACGTGACGAAT 3'           (SEQ ID NO:4)
```

Product size: 182 bps

Real-Time Quantitative PCR Assay

Total RNA from 140 µl of nasopharyngeal aspirate (NPA) was extracted by QIAamp® virus RNA mini kit (Qiagen) as instructed by the manufacturer. Ten µl of eluted RNA samples were reverse transcribed by 200 U of Superscript II® reverse transcriptase (Invitrogen) in a 20 µl reaction mixture containing 0.15 µg of random hexamers, 10 mmol/l DTT, and 0.5 mmol/l dNTP, as instructed. Complementary DNA was then amplified in a SYBR® Green I fluorescence reaction (Roche) mixtures. Briefly, 20 µl reaction mixtures containing 2 µl of cDNA, 3.5 mmol/l MgCl$_2$, 0.25 µmol/l of forward primer (5'-TACACACCTCAGCGTTG-3'; SEQ ID NO:3) and 0.25 µmol/l reverse primer (5'-CACGAACGTGACGAAT-3'; SEQ ID NO:4) were thermal-cycled by a Light-Cycler (Roche) with the PCR program, [95° C., 10 min followed by 50 cycles of 95° C., 10 min; 57° C., 5 sec; 72° C. 9 sec]. Plasmids containing the target sequence were used as positive controls. Fluorescence signals from these reactions were captured at the end of extension step in each cycle. To determine the specificity of the assay, PCR products (184 base pairs) were subjected to a melting curve analysis at the end of the assay (65° C. to 95° C., 0.1° C. per second).

6.8 Detection of N-Gene of hSARS Virus in Patients

6.8.1 RT-PCR Diagnosis Protocol for *Coronavirus* in SARS Patients

Equipment required (for 96 samples):
1×SV Total RNA Isolation system
2×Mega titer plate
3×96-well PCR plate
1×0.5-10 µl multi-channel pipette
1×10-100 µl multi-channel pipette
1×20-200 µl multi-channel pipette
1×vacuum pump
1×swing-bucket rotor with microtest plate buckets
2×PCR machine (96-well plate compatible)
1×Gel electrophoresis apparatus Station 1*—Clinical Samples Handling (1 Medical Officer/ Clinical Technician)

Aliquot 500 µl sample in viral transport medium (containing, per liter, 2 g of sodium bicarbonate, 5 g of bovine serum albumin, 200 µg of vancomycin, 18 µg of amikacin, and 160 U of nystatin in Earle's balanced salt solution) from each individual vial into a well of 96-well mega titer plate containing 500 µl lysis buffer (1×) containing 100 µl PK-15 cell (ATCC CCL-33; 5.0×10$^5$ cell/ml) in complete minimum essential medium with Earle's salt (EMEM, Invirtogen) as internal control.**

*Station 1 should be carried out inside Class III biological safety cabinet.
**At least two negative samples should be included in a 96-well platform as a negative control.

Mix the lysate by pipetting up-and-down 3 times
Proceed to Station 2.

Station 2—Total RNA Extraction (1 Laboratory Technician)

Set up the Vacuum Manifold unit. Place the binding plate onto the Manifold Base.
Transfer the lysate from mega titer plate to each well of the SV 96 Binding Plate (binding plate).
Apply vacuum until the lysate passes through the binding plate. Release vacuum.
Add 500 µl of SV RNA Wash Solution (wash solution) to each well of binding plate.
Apply vacuum until the wash solution passes through binding plate. Release vacuum.
Prepare DNase incubation mix for an entire 96-well plate as below:

| | |
|---|---|
| Yellow Core Buffer | 2 ml |
| 0.09 M MnCl$_2$ | 250 µl |
| DNase I | 250 µl |

Apply 25 µl freshly prepared DNase incubation mix directly to the membrane of the binding plate.
Incubate at 20-25° C. for 10 minutes.
Add 200 µl of SV DNase Stop Solution to each well of the binding plate.
Apply vacuum until the SV DNase Stop Solution passes through the binding plate. Release vacuum.
Add 500 µl wash solution to each well of the binding plate.
Apply vacuum until wash solution passes through the binding plate. Turn off vacuum.
Spin the binding plate at 3000×g for 30 seconds to remove residue wash solution.
Transfer the binding plate on top of a 96-well RT plate.
Add 50 µl nuclease-free water into each well of the binding plate to elute RNA.
Incubate at room temperature for 1 minute.
Spin the binding plate at 3000×g, 4° C. for 1 minute.
Collect eluted RNA in the 96-well RT plate.
Add 5 µl of 3 M sodium acetate and 200 µl of 95% ethanol into each well of the plate.
Place the RT plate on ice and incubate for 15 minutes.
Spin the plate at 3000×g, 4° C., 15 minutes.
Discard supernatant by inverting the plate and blotting on a clean paper towel.
Wash the pellet with 200 µl of 70% ethanol.
Spin the plate at 3000×g, 4° C., 10 minutes.
Discard supernatant by inverting the plate and blotting on a clean paper towel.
Air-dry the pellet for 5 minutes.
Add 12 µl of nuclease-free water into each well.
Vortex the plate briefly to dissolve the pellet (for an example result, see FIG. 18).
Proceed to Station 3.

Station 3—Reverse Transcription (1 Laboratory Technician)
Prepare RT master mix for an entire 96-well plate in a 1.5-ml tube as below (100 reactions):

| | Per Reaction | ×100 |
|---|---|---|
| Random hexamers, 3 µg/µl | 0.05 µl | 5 µl |
| DNTPs, 10 mM | 1 µl | 100 µl |
| First-strand buffer, 5× | 4 µl | 400 µl |
| DTT, 0.1 M | 2 µl | 200 µl |
| Superscript II, 200 U/µl | 1 µl | 100 µl |
| Total | 8.05 µl | 805 µl |

Aliquot 100 µl RT mix into 8 wells of a clean 96-well master mix plate.
From this plate, transfer 8.05 µl RT mix to each well of RT plate containing 12 µl RNA, mix by pipetting up-and-down for 3 times with a multi channel pipette. REPLACE TIP AFTER EACH TRANSFER.
Incubate the samples at 42° C. for 50 minutes followed by 70° C. for 15 minutes.
Proceed to Station 4.

Station 4—N-Gene Specific PCR (1 Laboratory Technician)
Prepare PCR master mix for an entire 96-well plate in two 2059 culture tubes as below (100 reactions):

| | N-specific PCR | | Control PCR | |
|---|---|---|---|---|
| | Per 25 µl Reaction | ×100 | Per 25 µl Reaction | ×100 |
| mQH$_2$O | 18.65 µl | 1865 µl | 17.65 µl | 1765 µl |
| 10× PCR buffer | 2.5 µl | 250 µl | 2.5 µl | 250 µl |
| 25 mM MgCl2 | 1.5 µl | 150 µl | 2.5 µl | 250 µl |
| 10 mM dNTPs | 0.25 µl | 25 µl | 0.25 µl | 25 µl |
| Forward primer 10 µM | 0.5 µl | 50 µl | 0.5 µl | 50 µl |
| Reverse primer 10 µM | 0.5 µl | 50 µl | 0.5 µl | 50 µl |
| AmpliTaq Gold ® 500 U | 0.1 µl | 10 µl | 0.1 µl | 10 µl |
| Template DNA | 1 µl | — | 1 µl | — |
| Total | 25 µl | 2400 µl | 25 µl | 2400 µl |

N-gene specific PCR and control PCR are performed in two individual PCR plates.

Aliquot 290 µl PCR master mix into the first column of a 96-well PCR plate.

From the first column, aliquot 24 µl of master mix into each well of PCR plate.

Transfer 1 µl of cDNA template (from station 4) into each well of PCR plate.

Mix by pipetting up-and-down for 3 times with a multi-channel pipette. REPLACE TIP AFTER EACH TRANSFER.

Seal the plate with sealing tape.

Perform the following reaction in two 96-well PCR machines:

| N-gene specific PCR | | Control PCR | |
|---|---|---|---|
| 94° C. 10 minutes | | 94° C. 10 minutes | |
| 94° C. 30 seconds | } 40 cycles | 94° C. 30 seconds | } 35 cycles |
| 56° C. 30 seconds | | 55° C. 30 seconds | |
| 72° C. 30 seconds | | 72° C. 45 seconds | |
| 72° C. 10 minutes | | 72° C. 10 minutes | |

Station 5—Gel Electrophoresis (1 Laboratory Technician)

Mix 5 µl of N-gene specific PCR product and 5 µl control PCR product with 1 µl bromophenol blue loading dye Load the samples into the wells of a 2% agarose gel.

Electrophoresize the PCR products at 140V, 250 mA for 30 minutes.

Stain the gel with ethidium bromide.

Visualize the products with UV and record the result.

6.8.2 Using Primers of SEQ ID NOS:2480 and 2481

RT-PCR diagnostic protocol was performed as described in Section 6.8.1 with some modifications.

RNA Isolation from Clinical Samples

Clinical samples including nasopharyngeal aspirates (NPA) and stool specimens were provided by the Department of Microbiology, The University of Hong Kong. In addition, tracheal dispersion and lung biopsy from an index patient A described in *New Engl. J Med.* 348:1967-76 (by Drosten C. S., et al., 2003) at three time points was also collected. Sample collection was conducted from Apr. 1 to Apr. 28, 2003 in local hospitals. Method of sample collection was described in the previous section (also see, Poon et al., 2003, Clinical Chemistry 49:953-955). Total RNA extraction from clinical samples was carried out with SV96 Total RNA Isolation System (Promega, Wis., USA), with following modifications from manufacturer's protocol. Five-hundred (500) µl of NPA/stool sample in viral transport medium (containing, per liter, 2 g of sodium bicarbonate, 5 g of bovine serum albumin, 200 µg of vancomycin, 18 µg of amikacin, and 160 U of nystatin in Earle's balanced salt solution) was mixed with equal volume of SV RNA Lysis Buffer containing 100 µl of pig kidney epithelial (PK-15) cell (ATCC CCL-33; 5.0×10$^5$ cells/ml) in complete minimum essential medium with Earle's salt (EMEM, Invitrogen) as internal control. The mixture was transferred to the wells of the SV 96 Binding Plate. After washing with 500 µl of SV RNA Wash Solution prior to elution step, the plate was spun at 3000×g for 30 seconds to remove residue wash solution. RNA was then eluted with 50 µl of nuclease-free water, and was collected in a clean 96-well PCR plate by spinning the plate at 3000×g for 1 minute. Eluted RNA was then concentrated by incubating on ice for 15 minutes, in the presence of 5 µl of 3 M sodium acetate and 200 µl of 95% ethanol. After centrifugation at 3000×g, 4° C. for 15 minutes, RNA pellet was washed with 200 µl of 75% ethanol and dissolved with 12 µl of nuclease-free water. Extracted RNA was immediately reverse-transcribed to first-strand cDNA.

First-Strand cDNA Synthesis

Reverse-transcription was performed with 200 U of Superscript® II reverse transcriptase (Invitrogen, USA) in a 20 µl reaction containing 0.15 µg of random hexamers, RT buffer (1×), 10 mM dithiothreitol (DTT) and 0.5 mM deoxynucleotide triphosphates (dNTPs). Reaction was carried out in Peltier Thermal Cycler (MJ Research) with the following conditions: 50 minutes at 42° C. followed by 15 minutes at 70° C.

Polymerase Chain Reaction (PCR)

Primers were designed according to complete SARS CoV genomic sequence of a local specimen HK-39 announced previously (accession no. AY278491). Forward primer (SRS251: 5'-GCAGTCAAGCCTCTTCTCG-3'; SEQ ID NO:2480, corresponding to nt 28658-28676 of HK-39 SARS genome, i.e., CCTCC200303) and reverse primer (SRS252: 5'-GCCTCAGCAGCAGATTTC-3', SEQ ID NO:2481; corresponding to nt 28866-28883 of HK-39 SARS genome) amplified a 225 bp fragment from the region of N-gene that showed no homology to other *coronavirus*. Primers amplifying RNA-dependent RNA polymerase (1b gene) were used as parallel control (coro3: 5'-TACACACCTCAGCGTTG-3' (SEQ ID NO:3), corresponding to nt 18041-18057; and coro4: 5'-CACGAACGTGACGAAT-3' (SEQ ID NO:4), corresponding to nt 18207-18222, Department of Microbiology, the University of Hong Kong). Both amplicons were cloned into same pCR2.1 cloning vector (FIG. 17). Serially diluted plasmid was then used to determine the dynamic range and optimal condition of the PCRs (FIGS. 21A and 21B). Another set of primer that amplifying a 745 bp fragment from pig β-actin gene was employed as an internal control for the diagnostic PCR assay (actin-F: 5'-TGAGACCTTCAA-CACGCC-3' (SEQ ID NO:2482); and actin-R: 5'-ATCT-GCTGGAAGGTGGAC-3' (SEQ ID NO:2483)).

Conventional PCR and gel electrophoresis was carried out as preliminary experiment. Briefly, 1 µl of cDNA from clinical samples was amplified with 0.5 U Taq DNA polymerase recombinant (Invitrogen Life Technologies) in a 25-µl reaction containing PCR buffer (1×), 1.5 mM MgCl$_2$, 0.1 mM dNTPs and 0.5 pmol of each forward and reverse primers. Reaction was performed in Peltier Thermal Cycler (MJ Research) with the following conditions: 3 minutes at 94° C., followed by 50 cycles of 94° C. for 10 seconds, 56° C. for 10 seconds, 72° C. for 10 seconds, and a 10-minute final extension step at 72° C. Amplicons were analyzed with 2% agarose gel electrophoresis (FIG. 23). Quantitative real-time PCR using SYBR® SYBR® green fluorophore was performed in diagnosis of clinical samples. In a 25 µl reaction, 1 µl cDNA template was mixed with 12.5 µl (2×) Green PCR Master Mix (Applied Biosystems) and 0.5 pmol of each forward and reverse primer. Volume of the reaction was adjusted to 25 µl with distilled water. Reactions were performed in the iCycler iQ Real-Time PCR Detection System (Bio-Rad) under the same condition as the conventional PCR. Fluorescence signals (FAM, excitation=490 nm, emission=530 nm) were collected at the end of each extension step during the PCR cycles (FIG. 22A). Threshold cycle (Ct) of each sample was determined using maximum curvature approach. Melting curve analysis was performed after 10 minutes final extension (FIG. 22B). cDNA from non-SARS patients, including patients suffering from adenovirus (n=5), repiratory syncytial virus (n=5), human metapneumovirus (n=5), influenza A virus (n=5), or influenza B virus (n=5) infection, were used as negative controls for the assay.

Northern Blot Analysis

SARS-CoV HK-39 strain infected Vero cell was provided by Department of Microbiology, the University of Hong Kong. Total RNA was extracted from the cell with TRIzol° reagent (Invitrogen Life Technologies) according to the manufacturer's protocol. Eight (8) μg of total RNA was separated by electrophoresis on a 1% agarose gel containing 3.7% formaldehyde. RNA was transferred to a positively charged nylon membrane Roche Diagnostic Corporation) by capillary blotting and fixed by UV cross-linking. cDNA synthesized with the same RNA sample was used as template for probe synthesis. Four pairs of primers amplifying fragments from 1b (nt 18057-18222; SEQ ID NO:2484), S (nt 21920-22107; SEQ ID NO:2485), M (nt 26867-26996; SEQ ID NO:2486) and N (nt 28658-28883; SEQ ID NO:2487) gene were used in probe synthesis. DIG-labeling of probes, hybridization and detection of bands were performed with the digoxigenin system according to the manufacturer's procedures (Roche Molecular Biochemcials). Signals were then analysed with chemiluminescence (FIG. 24).

Results and Discussion

A large-scale RT-PCR assay provides a rapid means in monitoring and screening of SARS suspects. The result can be used to complement clinical diagnostic evaluation. In order to achieve a diagnostic purpose, the assay should be reliable and its accuracy should be assured so as to prevent occurrence of both false negative and false positive results. However, accuracy of the test may be influenced by several factors. A common technical problem with PCR is a failure of amplification due to the presence of PCR inhibitors (see FIG. 21).

These PCR inhibitors included heme compounds found in blood, aqueous and vitreous humors, heparin, EDTA, urine and polyamines (Fredricks et al., 1998, J. Clin. Micro. 36:2810-16). Currently, NPA or stool samples were collected into transport medium to maintain the viability of the viral particles. RT-PCR was inhibited when total RNA extracted was used directly for first-strand cDNA synthesis without any treatment (25 out of 27 samples) in preliminary experiment. However, after a simple ethanol precipitation step, the amplification of DNA could be retained (FIG. 19). Same result was obtained by either using SV or SV96 total RNA Isolation System (data not shown). It demonstrated that some components either in the medium or NPA/stool samples would affect the downstream processes of the diagnosis test.

In addition, current sample collection procedure dilutes the virus titer in the samples, especially during early stage of infection, in which the virus titer is low in nasal and throat swab specimens (Drosten et al., 2003, New England Journal of Medicine, on-line at http://content.nejm.org/cgi/reprint/NEJMoa030747v2). It was suggested that the sensitivity of PCR tests for SARS depended on the quality of the specimen and the time of testing during the course of the illness. In order to increase sensitivity of the test, total RNA isolated from clinical samples was concentrated prior to 1st strand cDNA synthesis.

In order to avoid false negative PCR results due to failure in the process of RNA isolation and 1st strand cDNA synthesis, total RNA was extracted from clinical samples in parallel with PK-15 mammalian cells. FIG. 23 showed the RT-PCR screening result on 48 clinical samples, including both NPA and stool samples. Diagnostic PCR was performed in parallel with β-actin PCR. All samples were positive in β-actin PCR. The result indicated that RNA and cDNA could be extracted and synthesized successfully from the samples in a single-step protocol as disclosed herein. With this internal control, total RNA isolation and cDNA synthesis from the samples were ensured, which eliminated false negative that resulted from failure in either one of the above processes. Moreover, 96-well assay format currently developed can be adopted into a high-throughput screening protocol, with which we are able to obtain diagnostic result of more than 90 clinical samples in 3 hours with 1 clinical personnel, while the current existing protocol, in which samples are proceeded in individual tubes, can only handle about 30-50 samples a day per technician.

Real-time quantitative PCR assay is more sensitive than conventional agarose gel-electrophoresis-associated PCR assay (Poon et al., J. Clin. Virol. 28:233-8) and therefore employed for SARS-CoV diagnosis purpose. Positive signals were detected in 38 of 136 randomly selected clinical samples in both N-gene and 1b-gene specific PCR. Among these 38 positives, 3 were stool samples (2.2%) and 35 were NPA samples (25.7%). Detection rate of the assay employing N-gene specific RT-PCR at different time points was shown in Table 2.

TABLE 2

| Date of onset | No. of sample | No. of positive | Detection rate (%) |
| --- | --- | --- | --- |
| 1-2 | 15 | 2 | 13.3 |
| 3-4 | 17 | 4 | 23.5 |
| 5-6 | 15 | 4 | 26.7 |
| 7-8 | 13 | 5 | 38.5 |
| 9-10 | 9 | 4 | 44.4 |
| Negative control | 19 | All negative | — |

Affirmative of these 38 positive cases was confirmed by melting curve analysis of PCR products. Specific melting temperature of N gene and 1b gene PCR products (85.5° C. and 80.5° C., respectively) indicated that the target framgments were amplified in the reaction. Specificity of the assay was also validated with non-SARS patients samples, including patients suffering from adenovirus (n=5), repiratory syncytial virus (n=5), human metapneumovirus (n=5), influenza A virus (n=5) and influenza B virus (n=5). The result shows that all of these samples were negative in the assay (FIG. ??). These results indicate that the N-gene specific RT-PCR assay is specific for SARS-CoV diagnosis.

Furthermore, we also demonstrated that the N-gene specific PCR was more sensitive than that of PCR amplifying 1b RNA polymerase gene. Amplification conditions for both PCR assays were optimized (see FIG. 22) first with the plasmid construct containing 1:1 ratio of 1b- and N-gene fragment (see FIG. 20). Dynamic range of N-gene specific PCR was obtained (FIG. ??) and it was found to be with lower Ct values than that of 1b-specific PCR. This revealed that N-gene specific PCR could achieve higher amplification efficiency than 1b-gene specific PCR when using same copy number of template. PCR with cDNA from clinical samples or virus infected Vero cells were then performed. FIG. 22A shows the Ct and half-maximal values of the fluorescent signal of N gene and 1b gene specific PCR generated from NPA, tracheal dispersion and lung biopsy from patient A. The results indicated that fluorescent signals given in N gene specific PCR are higher (26.0% in average, ranged from 6.3-60%) than that of 1b specific PCR in all positive samples. Furthermore, Ct values of N gene specific PCR are lower (0.1-4.6 cycles) than that of 1b specific PCR among most of the SARS-CoV positive samples (Table 3).

TABLE 3

| S/N | N | 1b | ?Ct | S/N | N | 1b | ?Ct | S/N | N | 1b | ?Ct | S/N | N | 1b | ?Ct |
|---|---|---|---|---|---|---|---|---|---|---|---|---|---|---|---|
| 56851 | 27.1 | 27.8 | 0.6 | 34862 | 31.9 | 33.2 | 1.3 | 67429 | 35.3 | 35.6 | 0.3 | 68796 | 32.4 | 34.5 | 2.1 |
| 55751 | 27.6 | 27.7 | 0.1 | 45971 | 43.6 | 48.2 | 4.6 | 67438 | 28.4 | 27.5 | -0.9 | 68798 | 28.8 | 28.4 | -0.4 |
| 62290 | 41.9 | 43.2 | 1.3 | 45972 | 43.6 | 46.5 | 2.9 | 68116 | 30.0 | 33.5 | 3.5 | 68800 | 34.6 | 38.3 | 3.7 |
| 55531 | 41.0 | 43.1 | 2.1 | 45973 | 42.1 | 43.2 | 1.1 | 68118 | 36.7 | 37.7 | 1.0 | 68801 | 31.9 | 32.8 | 0.9 |
| 55963 | 41.7 | 42.3 | 0.6 | 69145 | 27.2 | 27.7 | 0.5 | 68134 | 32.4 | 33.2 | 0.8 | 70562 | 40.2 | 43.3 | 3.1 |
| 65733 | 43.6 | 44.9 | 1.3 | 56386 | 32.8 | 33.8 | 1.0 | 68184 | 30.6 | 32.4 | 1.8 | 70589 | 35.5 | 38.2 | 2.7 |
| 34862 | 33.5 | 33.7 | 0.2 | 55527 | 37.3 | 39.4 | 2.1 | 68185 | 27.5 | 30.1 | 2.6 | 70591 | 36.0 | 38.2 | 2.2 |
| 32814 | 38.6 | 40.8 | 2.2 | 56851 | 23.9 | 26.1 | 2.2 | 68187 | 40.3 | 41.5 | 1.2 | 70059 | 41.4 | 43.1 | 1.7 |
| 33935 | 35.3 | 36.5 | 1.2 | 69073 | 24.3 | 26.1 | 1.3 | 68788 | 35.5 | 37.6 | 2.1 | | | | |
| 34861 | 31.4 | 31.7 | 0.3 | 67423 | 28.7 | 29.4 | 0.7 | 68791 | 34.8 | 35.3 | 0.5 | | | | |

$\Delta Ct = 1.49 \pm 0.47$,
95% confidence intervals = 0.74 to 2.23 (F-test)

Statistic analysis indicates that Ct of N-gene PCR assay is significantly lower than that of ab-gene assay (95% confidence interval=0.74 to 2.23, F-test). Stronger fluorescence signals and lower Ct values of N gene specific PCR provide a more sensitive diagnostic result and much target for the assay.

Using cDNA from SARS-CoV infected Vero cells, amplification curves shown in FIG. 21B show the differences between N gene and 1b gene specific PCR. Ct of the N gene and 1b gene specific PCR was 35.3 and 37.8, respectively. This phenomenon had two main causes: (1) Expression level of N gene was higher than that of 1b gene; and; (2) Copy number of N gene was much larger than that of 1b gene because each transcript preceded a copy of N gene, in SARS-CoV infected cells. Northern blot analysis supported this hypothesis (FIG. 24). When N-gene specific PCR product was used as a probe, at least five transcripts from the virus were hybridized and gave positive signals (FIG. 24). This result agreed with the findings in which five subgenomic mRNAs were detected by Northern hybridization of RNA from SARS-CoV infected cells using a probe derived from the 3' untranslated region (Rota et al., 2003, *Science* 300: 1394-99). On the other hand, when 1b PCR product was used as a probe, only 2 transcripts with high molecular size were hybridized, demonstrating that the copy number of N gene was much higher than that of 1b gene, during transcription and gene expression in the host cells. The Northern hybridization result strongly supports the conclusion that PCR amplifying regions in N gene of the SARS-CoV are more sensitive than other regions as a target for diagnostic screening. It is possible that amplification of more than one genome region may increase the specificity of the test (Yam W. C., et al., 2003, *J. Clin. Microbiol.* 41:4521-24).

In conclusion, we have developed a new generation of RT-PCR diagnosis test which is more sensitive than conventional diagnostic test for the detection of the *coronavirus* associated with SARS. The assay provides a high throughput, highly sensitive screening platform, which enables us to scale up to test hundreds of thousands of suspected SARS cases each day in a single working line. Incorporation of PK-15 cell as an internal control in the assay and use of N gene as a diagnosis locus in addition to 1b gene can enhance the sensitivity and accuracy of the test. We are adapting the protocol to 96-well real-time quantitative PCR and sequencing format to shorten the time required for the test and to obtain information on genotypic variation of the virus.

Clinical Results
  Clinical Findings:
  All 50 patients with SARS were ethnic Chinese. They represented 5 different epidemiologically linked clusters as well as additional sporadic cases fitting the case definition. They were hospitalized at a mean of 5 days after the onset of symptoms. The median age was 42 years (range of 23 to 74) and the female to male ratio was 1.3. Fourteen (28%) were health care workers and five (10%) had a history of visit to a hospital experiencing a major outbreak of SARS. Thirteen (26%) patients had household contacts and 12 (24%) others had social contacts with patients with SARS. Four (8%) had a history of recent travel to mainland China.

The major complaints from most patients were fever (90%) and shortness of breath. Cough and myalgia were present in more than half the patients (Table 4). Upper respiratory tract symptoms such as rhinorrhea (24%) and sore throat (20%) were present in a minority of patients. Diarrhea (10%) and anorexia (10%) were also reported. At initial examination, auscultatory findings, such as crepitations and decreased air entry, were present in only 38% of patients. Dry cough was reported by 62% of patients. All patients had radiological evidence of consolidation, at the time of admission, involving 1 zone (in 36), 2 zones (13) and 3 zones (1).

TABLE 4

| Clinical symptoms | Number (percentage) |
|---|---|
| Fever | 50 (100%) |
| Chill or rigors | 37 (74%) |
| Cough | 31 (62%) |
| Myalgia | 27 (54%) |
| Malaise | 25 (50%) |
| Running nose | 12 (24%) |
| Sore throat | 10 (20%) |
| Shortness of breath | 10 (20%) |
| Anorexia | 10 (20%) |
| Diarrhea | 5 (10%) |
| Headache | 10 (20%) |
| Dizziness | 6 (12%) |

* Truncal maculopapular rash was noted in 1 patient.

In spite of the high fever, most patients (98%) had no evidence of a leukocytosis. Lymphopenia (68%), leucopenia (26%), thrombocytopenia (40%) and anemia (18%) were present in peripheral blood examination (Table 5). Parenchymal liver enzyme, alanine aminotransferase (ALT) and muscle enzyme, creatinine kinase (CPK) were elevated in 34% and 26% respectively.

TABLE 5

| Laboratory parameter | Mean (range) | Percentage of abnormal | Normal range |
|---|---|---|---|
| Haemoglobin | 12.9 (8.9-15.9) | | 11.5-16.5 g/dl |
| Anaemia | | 9 (18%) | |

TABLE 5-continued

| Laboratory parameter | Mean (range) | Percentage of abnormal | Normal range |
|---|---|---|---|
| White cell count | 5.17 (1.1-11.4) | | 4-11 × 10$^9$/L |
| Leucopenia | | 13 (26%) | |
| Lymphocyte count | 0.78 (0.3-1.5) | | 1.5-4.0 × 10$^9$/L |
| Significant lymphopenia (<1.0 × 10$^9$/L) | | 34 (68%) | |
| Platelet count | 174 (88-351) | | 150-400 × 10$^9$/L |
| Thrombocytopenia | | 20 (40%) | |
| Alanine aminotransaminase (ALT) | 63 (11-350) | | 6-53 U/L |
| Elevated ALT | | 17 (34%) | |
| Albumin | 37 (26-50) | | 42-54 g/L |
| Low albumin | | 34 (68%) | |
| Globulin | 33 (21-42) | | 24-36 g/L |
| Elevated globulin | | 10 (20%) | |
| Creatinine kinase | 244 (31-1379) | | 34-138 U/L |
| Elevated creatinine kinase | | 13 (26%) | |

Routine microbiological investigations for known viruses and bacteria by culture, antigen detection, and PCR were negative in most cases. Blood culture was positive for *Escherichia coli* in a 74-year-old male patient, who was admitted to intensive care unit, and was attributed to hospital acquired urinary tract infection. *Klebsiella pneumoniae* and *Hemophilus influenzae* were isolated from the sputum specimens of 2 other patients on admission.

Oral levofloxacin 500 mg q24 h was given in 9 patients and intravenous (1.2 g q8 h)/oral (375 mg tid) amoxicillin-clavulanate and intravenous/oral clarithromycin 500 mg q12 h were given in another 40 patients. Four patients were given oral oseltamivir 75 mg bid. In one patient, intravenous ceftriaxone 2 gm q24 h, oral azithromycin 500 mg q24 h, and oral amantadine 100 mg bid were given for empirical coverage of typical and atypical pneumonia.

Nineteen patients progressed to severe disease with oxygen desaturation and were required intensive care and ventilatory support. The mean number of days of deterioration from the onset of symptoms was 8.3 days. Intravenous ribavirin 8 mg/kg q8 h and steroid was given in 49 patients at a mean day of 6.7 after onset of symptoms.

The risk factors associated with severe complicated disease requiring intensive care and ventilatory support were older age, lymphopenia, impaired ALT, and delayed initiation of ribavirin and steroid (Table 6). All the complicated cases were treated with ribavirin and steroid after admission to the intensive care unit whereas all the uncomplicated cases were started on ribavirin and steroid in the general ward. As expected, 31 uncomplicated cases recovered or improved whereas 8 complicated cases deteriorated with one death at the time of writing. All 50 patients were monitored for a mean of 12 days at the time of writing.

TABLE 6

| | Complicated case (n = 19) | Uncomplicated case (n = 31) | P value |
|---|---|---|---|
| Mean (SD) age (range) | 49.5 ± 12.7 | 39.0 ± 10.7 | P < 0.01 |
| Male/Female ratio | 8/11 | 14/17 | N.S. |
| Underlying illness | 5 † | 1 ‡ | P < 0.05 |
| Mode of contact | | | |
| Travel to China | 1 | 3 | N.S. |
| Health care worker | 5 | 9 | N.S. |
| Hospital visit | 1 | 4 | N.S. |
| Household contact | 8 | 5 | P < 0.05 |
| Social contact | 4 | 10 | N.S. |
| Mean (SD) duration of symptoms to admission (days) | 5.2 ± 2.0 | 4.7 ± 2.5 | N.S. |
| Mean (SD) admission temperature (° C.) | 38.8 ± 0.9 | 38.7 ± 0.8 | N.S. |
| Mean (SD) initial total peripheral WBC count (×10$^9$/L) | 5.1 ± 2.4 | 5.2 ± 1.8 | N.S. |
| Mean (SD) initial lymphocyte count (×10$^9$/L) | 0.66 ± 0.3 | 0.85 ± 0.3 | P < 0.05 |
| Presence of thrombocytopenia (<150 × 10$^9$/L) | 8 | 12 | N.S. |
| Impaired liver function test | 11 | 6 | P < 0.01 |
| CXR changes (number of zone affected) | 1.4 | 1.2 | N.S. |
| Mean (SD) day of deterioration from the onset of symptoms § | 8.3 ± 2.6 | Not applicable | |
| Mean (SD) day of initiation of Ribavirin & steroid from the onset of symptoms | 7.7 ± 2.9 | 5.7 ± 2.6 | P < 0.05 |
| Initiation of ribavirin & steroid after deterioration | 12 | 0 | P < 0.001 |
| Response to ribavirin & steroid Outcome | 11 | 28 | P < 0.05 |
| Improved or recovered | 10 | 31 | P < 0.01 |
| Not improving ‖ | 8 | 0 | P < 0.01 |

* Multi-variant analysis is not performed due to low number of cases;
† 2 patients had diabetic mellitus, 1 had hypertrophic ostructive cardiomyopathy, 1 had chronic active hepatitis B, and 1 had brain tumour;
‡ 1 patient had essential hypertension;
§ desaturation requiring intensive care support;
‖ 1 died.

Two virus isolates, subsequently identified as a member of Coronaviridae (see below), were isolated from two patients. One was from an open lung biopsy tissue of a 53-year-old Hong Kong Chinese resident and the other from a nasopharyngeal aspirate of a 42 year-old female with good previous health. The 53-year old male had a history of 10-hour household contact with a Chinese visitor who came from Guangzhou and later died from SARS. Two days after this exposure, he presented with fever, malaise, myalgia, and headache. Crepitations were present over the right lower zone and there was a corresponding alevolar shadow on the chest radiograph. Hematological investigation revealed lymphopenia of 0.7× 10$^9$/l with normal total white cell and platelet counts. Both ALT (41 U/L) and CPK (405 U/L) were impaired. Despite a combination of oral azithromycin, amantadine, and intravenous ceftriaxone, there was increasing bilateral pulmonary infiltrates and progressive oxygen desaturation. Therefore, an open lung biopsy was performed 9 days after admission. Histopathological examination showed a mild interstitial inflammation with scattered alveolar pneumocytes showing cytomegaly, granular amphophilic cytoplasm and enlarged nuclei with prominent nucleoli. No cells showed inclusions typical of herpesvirus or adenovirus infection. The patient required ventilation and intensive care after the operative procedure. Empirical intravenous ribavirin and hydrocortisone were given. He succumbed 20 days after admission. In retrospect, *coronavirus*-like RNA was detected in his nasopharyngeal aspirate, lung biopsy and post-mortem lung. He had a significant rise in titer of antibodies against his own hSARS isolate from 1/200 to 1/1600.

The second patient from whom a hSARS virus was isolated, was a 42-year-old female with good past health. She had a history of travel to Guangzhou in mainland China for 2 days. She presented with fever and diarrhea 5 days after her return to Hong Kong. Physical examination showed crepitation over the right lower zone which had a corresponding alveolar shadow on the chest radiograph. Investigation revealed leucopenia ($2.7\times10^9$/L), lymphopenia ($0.6\times10^9$/L), and thrombocytopenia ($104\times10^9$/L). Despite the empirical antimicrobial coverage with amoxicillin-clavulanate, clarithromycin, and oseltamivir, she deteriorated 5 days after admission and required mechanical ventilation and intensive care for 5 days. She gradually improved without receiving treatment with ribavirin or steroid. Her nasopharyngeal aspirate was positive for the virus in the RT-PCR and she was seroconverted from antibody titre <1/50 to 1/1600 against the hSARS isolate.

Virological Findings:

Viruses were isolated on FRhk-4 cells from the lung biopsy and nasopharyngeal aspirate respectively, of two patients described above. The initial cytopathic effect appeared between 2 and 4 days after inoculation, but on subsequent passage, cytopathic effect appeared in 24 hours. Both virus isolates did not react with the routine panel of reagents used to identify virus isolates including those for influenza A, B parainfluenza types 1,2,3, adenovirus and respiratory syncytial virus (DAKO, Glostrup, Denmark). They also failed to react in RT-PCR assays for influenza A and HMPV or in PCR assays for mycoplasma. The virus was ether sensitive, indicating that it was an enveloped virus. Electron microscopy of negatively stained (2% potassium phospho-tungstate, pH 7.0) cell culture extracts obtained by ultracentrifugation showed the presence of pleomorphic enveloped viral particles, of about 80-90 nm (ranging 70-130 nm) in diameter, whose surface morphology appeared comparable to members of Coronaviridae (FIG. 5*a*). Thin section electron microscopy of infected cells revealed virus particles of 55-90 nm diameter within the smooth-walled vesicles in the cytoplasm (FIG. 5*b*). Virus particles were also seen at the cell surface. The overall findings were compatible with infections in the cells caused by viruses of Coronaviridae.

A thin section electron micrograph of the lung biopsy of the 53 year old male contained 60-90-nm viral particles in the cytoplasm of desquamated cells. These viral particles were similar in size and morphology to those observed in the cell-cultured virus isolate from both patients (FIG. 4).

The RT-PCR products generated in a random primer RT-PCR assay were analyzed and unique bands found in the virus infected specimen was cloned and sequenced. Of 30 clones examined, a clone containing 646 base pairs (SEQ ID NO:1) of unknown origin was identified. Sequence analysis of this DNA fragment suggested this sequence had a weak homology to viruses of the family of Coronaviridae (data not shown). Deducted amino acid sequence (215 amino acids: SEQ ID NO:2) from this unknown sequence, however, had the highest homology (57%) to the RNA polymerase of bovine *coronavirus* and murine hepatitis virus, confirming that this virus belongs to the family of Coronaviridae. Phylogenetic analysis of the protein sequences showed that this virus, though most closely related to the group II coronaviruses, was a distinct virus (FIGS. 5*a* and 5*b*).

Based on the 646 bp sequence of the isolate, specific primers for detecting the new virus was designed for RT-PCR detection of this hSARS virus genome in clinical specimens. Of the 44 nasopharyngeal specimens available from the 50 SARS patients, 22 had evidence of hSARS RNA. Viral RNA was detectable in 10 of 18 fecal samples tested. The specificity of the RT-PCR reaction was confirmed by sequencing selected positive RT-PCR amplified products. None of 40 nasophararyngeal and fecal specimens from patients with unrelated diseases were reactive in the RT-PCR assay.

To determine the dynamic range of real-time quantitative PCR, serial dilutions of plasmid DNA containing the target sequence were made and subjected to the real-time quantitative PCR assay. As shown in FIG. 7A, the assay was able to detect as little as 10 copies of the target sequence. By contrast, no signal was observed in the water control (FIG. 7A). Positive signals were observed in 23 out of 29 serologically confirmed SARS patients. In all of these positive cases, a unique PCR product ($T_m$=82° C.) corresponds to the signal from the positive control was observed (FIG. 7B, and data not shown). These results indicated this assay is highly specific to the target. The copy numbers of the target sequence in these reactions range from 4539 to less than 10. Thus, as high as $6.48\times10^5$ copies of this viral sequence could be found in 1 ml of NPA sample. In 5 of the above positive cases, it was possible to collect NPA samples before seroconvertion. Viral RNA was detected in 3 of these samples, indicating that this assay can detect the virus even at the early onset of infection.

To further validate the specificity of this assay, NPA samples from healthy individuals (n=11) and patients suffered from adenovirus (n11), respiratory syncytial virus (n=11), human metapneumovirus (n=11), influenza A virus (n=13) or influenza B virus (n=1) infection were recruited as negative controls. All of these samples, except one, were negative in the assay. The false positive case was negative in a subsequence test. Taken together, including the initial false positive case, the real-time quantitative PCR assay has sensitivity of 79% and specificity of 98%.

Epidemiological data suggest that droplet transmission is one of the major route of transmission of this virus. The detection of live virus and the detection of high copies of viral sequence from NPA samples in the current study clearly support that cough and sneeze droplets from SARS patients might be the major source of this infectious agent. Interestingly, 2 out of 4 available stool samples form the SARA patients in this study were positive in the assay (data not shown). The detection of the virus in feces suggests that there might be other routes of transmission. It is relevant to note that a number of animal coronaviruses are spread via the fecal-oral route (McIntosh K., 1974, Coronaviruses: a comparative review. *Current Top Microbiol Immunol.* 63: 85-112). However, further studies are required to test whether the virus in feces is infectious or not.

Currently, apart form this hSARS virus, there are two known serogroups of human coronaviruses (229E and OC43) (Hruskova J. et al., 1990, Antibodies to human coronaviruses 229E and OC43 in the population of C. R., *Acta Virol.* 34:346-52). The primer set used in the present assay does not have homology to the strain 229E. Due to the lack of available corresponding OC43 sequence in the Genebank, it is not known whether these primers would cross-react with this strain. However, sequence analyses of available sequences in other regions of OC43 polymerase gene indicate that the novel human virus associated with SARS is genetically distinct from OC43. Furthermore, the primers used in this study do not have homology to any of sequences from known coronaviruses. Thus, it is very unlikely that these primers would cross-react with the strain OC43.

Apart from the novel pathogen, metapneumovirus was reported to be identified in some of SARS patients (Center for Disease Control and Prevention, 2003, *Morbidity and Mortality Weekly Report* 52: 269-272). No evidence of metapneumovirus infection was detected in any of the patients in this study (data not shown), suggesting that the novel hSARS virus of the invention is the key player in the pathogenesis of SARS.

Figure 3:
Figure 6:
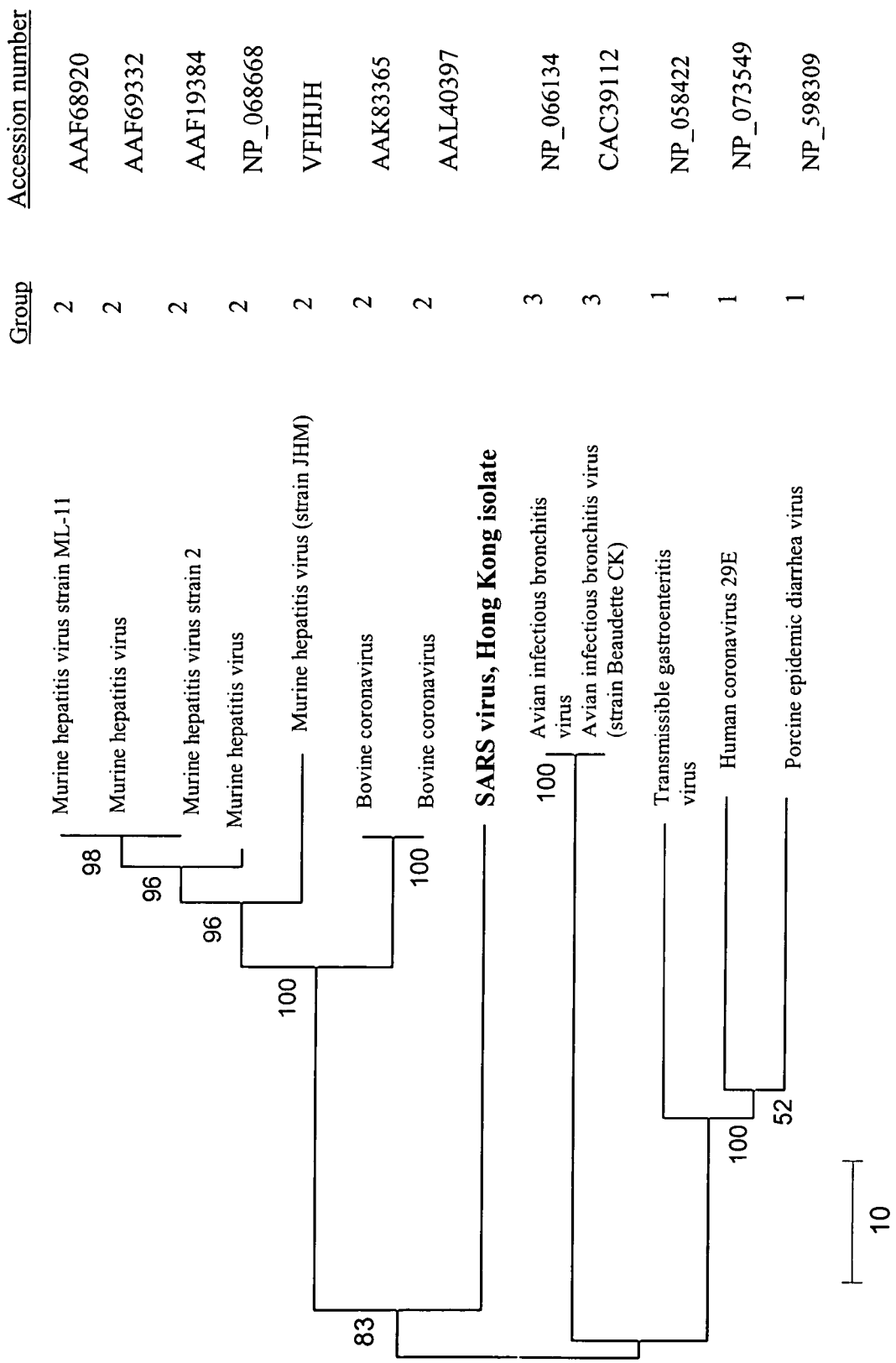
Figure 7A:
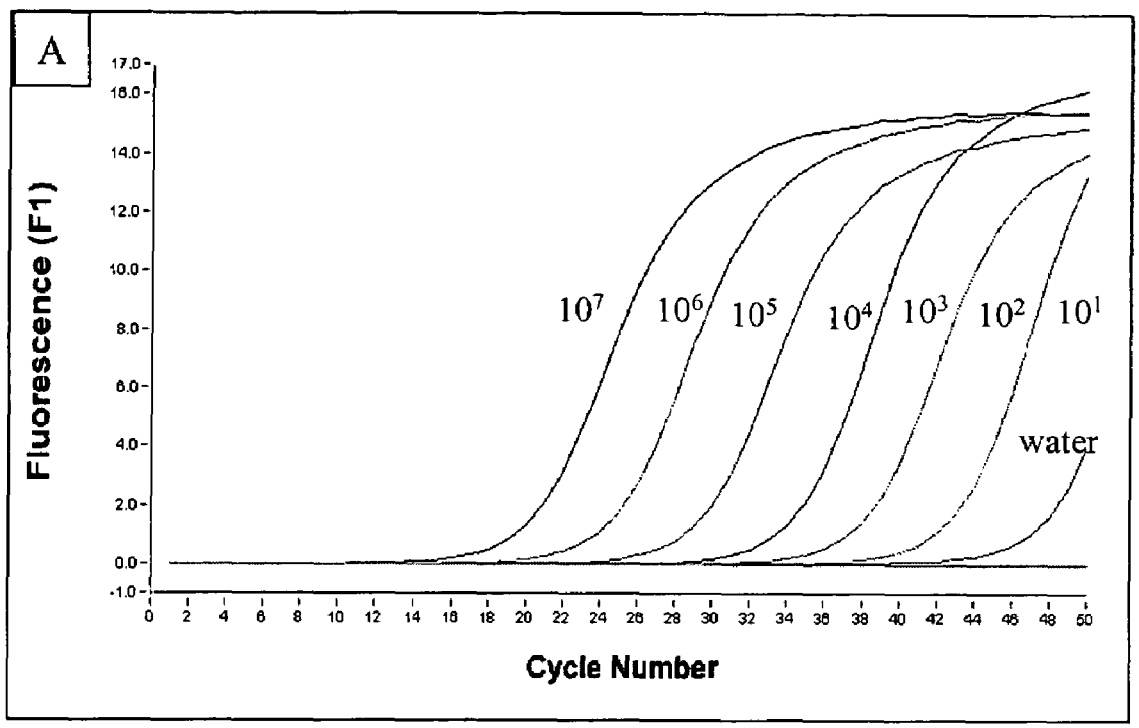
Figure 7B:
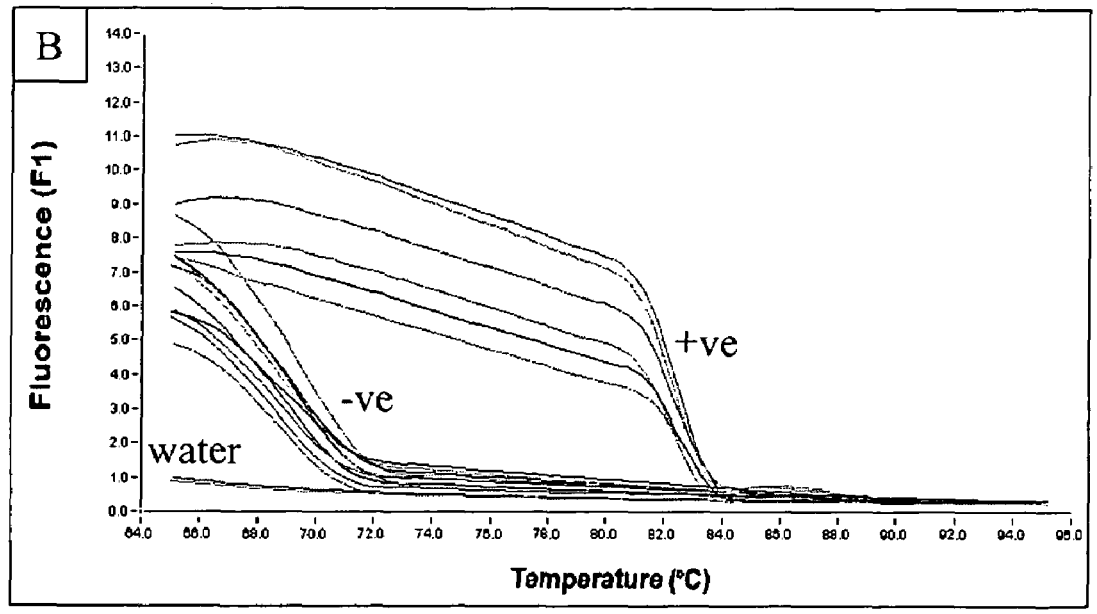
Figure 16:
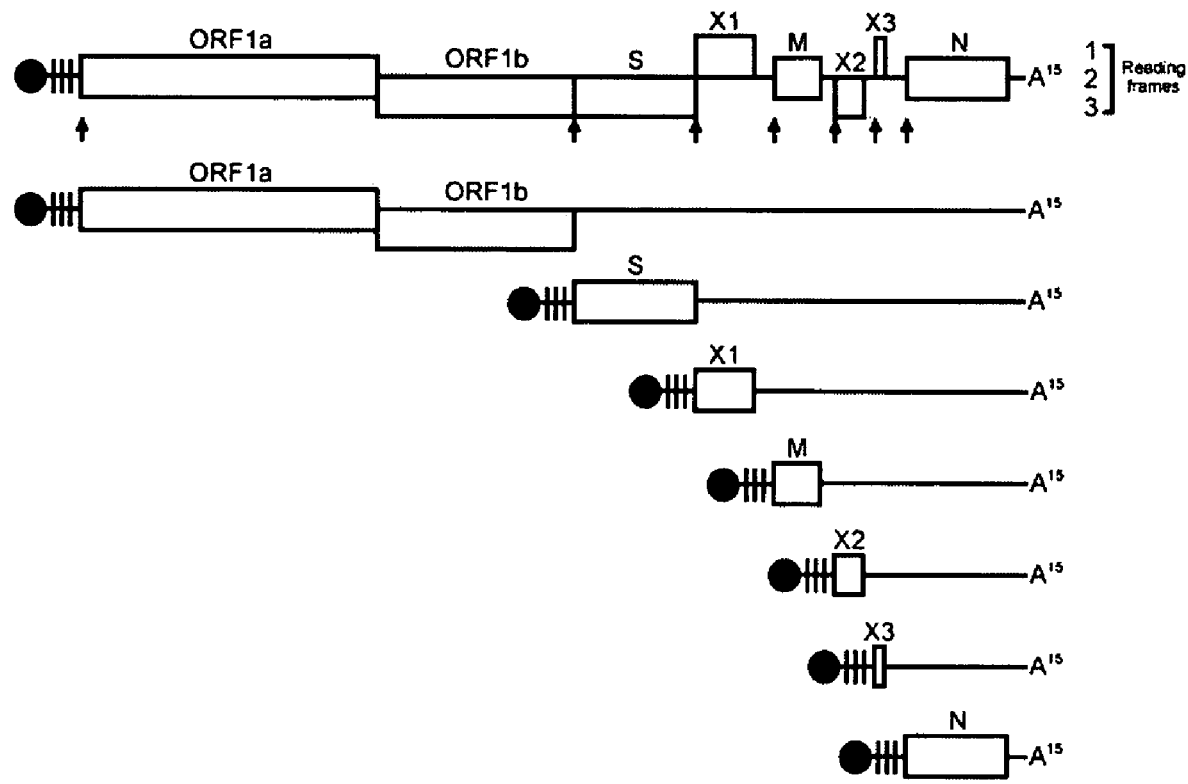

Immunofluorescent Antibody Detection:

Thirty-five of the 50 most recent serum samples from patients with SARS had evidence of antibodies to the hSARS (see FIG. 3). Of 27 patients from whom paired acute and convalescent sera were available, all were seroconverted or had >4 fold increase in antibody titer to the virus. Five other pairs of sera from additional SARS patients from clusters outside this study group were also tested to provide a wider sampling of SARS patients in the community and all of them were seroconverted. None of 80 sera from patients with respiratory or other diseases as well as none of 200 normal blood donors had detectable antibody.

When either seropositivity to HP-CV in a single serum or viral RNA detection in the NPA or stool are considered evidence of infection with the hSARS, 45 of the 50 patients had evidence of infection. Of the 5 patients without any virological evidence of Coronaviridae viral infection, only one of these patients had their sera tested >14 days after onset of clinical disease.

Discussion

The outbreak of SARS is unusual in a number of aspects, in particular, in the appearance of clusters of patients with pneumonia in health care workers and family contacts. In this series of patients with SARS, investigations for conventional pathogens of atypical pneumonia proved negative. However, a virus that belongs to the family Coronaviridae was isolated from the lung biopsy and nasopharyngeal aspirate obtained from two SARS patients, respectively. Phylogenetically, the virus was not closely related to any known human or animal *coronavirus* or *torovirus*. The present analysis is based on a 646 bp fragment (SEQ ID NO:1) of the polymerase gene, which indicates that the virus relates to antigenic group 2 of the coronaviruses along with murine hepatitis virus and bovine *coronavirus*. However, viruses of the Coronaviridae can undergo heterologous recombination within the virus family and genetic analysis of other parts of the genome needs to be carried out before the nature of this new virus is more conclusively defined (Holmes K V. Coronaviruses. Eds Knipe D M, Howley P M Fields Virology, 4th Edition, Lippincott Williams & Wilkins, Philadelphia, 1187-1203). The biological, genetic and clinical data, taken together, indicate that the new virus is not one of the two known human coronaviruses.

The majority (90%) of patients with clinically defined SARS had either serological or RT-PCR evidence of infection by this virus. In contrast, neither antibody nor viral RNA was detectable in healthy controls. All 27 patients from whom acute and convalescent sera were available demonstrated rising antibody titers to hSARS virus, strengthening the contention that a recent infection with this virus is a necessary factor in the evolution of SARS. In addition, all five pairs of acute and convalescent sera tested from patients from other hospitals in Hong Kong also showed seroconversion to the virus. The five patients who has not shown serological or virological evidence of hSARS virus infection, need to have later convalescent sera tested to define if they are also seroconverted. However, the concordance of the hSARS virus with the clinical definition of SARS appears remarkable, given that clinical case definitions are never perfect.

No evidence of HMPV infection, either by RT-PCR or rising antibody titer against HMPV, was detected in any of these patients. No other pathogen was consistently detected in our group of patients with SARS. It is therefore highly likely that that this hSARS virus is either the cause of SARS or a necessary pre-requisite for disease progression. Whether or not other microbial or other co-factors play a role in progression of the disease remains to be investigated.

The family Coronaviridae includes the genus *Coronavirus* and *Torovirus*. They are enveloped RNA viruses which cause disease in humans and animals. The previously known human coronaviruses, types 229E and OC43 are the major causes of the common cold (Holmes K V. Coronaviruses. Eds Knipe D M, Howley P M Fields Virology, 4th Edition, Lippincott Williams & Wilkins, Philadelphia, pp. 1187-1203). But, while they can occasionally cause pneumonia in older adults, neonates or immunocompromised patient (E l-Sahly H M, Atmar R L, Glezen W P, Greenberg S B. Spectrum of clinical illness in hospitalizied patients with "common cold" virus infections. *Clin Infect Dis.* 2000; 31: 96-100; and Foltz E J, Elkordy M A. *Coronavirus* pneumonia following autologous bone marrow transplantation for breast cancer. *Chest* 1999; 115: 901-905), Coronaviruses have been reported to be an important cause of pneumonia in military recruits, accounting for up to 30% of cases in some studies (Wenzel R P, Hendley J O, Davies J A, Gwaltney J M, *Coronavirus* infections in military recruits: Three-year study with *coronavirus* strains OC43 and 229E. *Am Rev Respir Dis.* 1974; 109: 621-624). Human coronaviruses can infect neurons and viral RNA has been detected in the brain of patients with multiple sclerosis (Talbot P J, Cote G, Arbour N. Human *coronavirus* OC43 and 229E persistence in neural cell cultures and human brains. *Adv Exp Med Biol.*—in press). On the other hand, a number of animal coronaviruses (eg. Porcine Transmissible Gastroenteritis Virus, Murine Hepatitis Virus, Avian Infectious Bronchititis Virus) cause respiratory, gastrointestinal, neurological or hepatic disease in their respective hosts (McIntosh K. Coronaviruses: a comparative review. *Current Top Microbiol Immunol.* 1974; 63: 85-112).

We describe for the first time the clinical presentation and complications of SARS. Less than 25% of patients with coronaviral pneumonia had upper respiratory tract symptoms. As expected in atypical pneumonia, both respiratory symptoms and positive auscultatory findings were very disproportional to the chest radiographic findings. Gastrointestinal symptoms were present in 10%. It is relevant that the virus RNA is detected in faeces of some patients and that coronaviruses have been associated with diarrhoea in animals and humans (Caul E O, Egglestone S I. Further studies on human enteric coronaviruses *Arch Virol.* 1977; 54: 107-17). The high incidence of deranged liver function test, leucopenia, significant lymphopenia, thrombocytopenia and subsequent evolution into adult respiratory distress syndrome suggests a severe systemic inflammatory damage induced by this hSARS virus. Thus immuno-modulation by steroid may be important to complement the antiviral therapy by ribavirin. In this regard, it is pertinent that severe human disease associated with the avian influenza subtype H5N1, another virus that recently crossed from animals to humans, has also been postulated to have an immuno-pathological component (Cheung C Y, Poon L L M, Lau A S Y et al. Induction of proinflammatory cytokines in human macrophages by influenza A (H5N1) viruses: a mechanism for the unusual severity of human disease. *Lancet* 2002; 360: 1831-1837). In common with H5N1 disease, patients with severe SARS are adults, are significantly more lymphopenic and have parameters of organ dysfunction beyond the respiratory tract (Table 4) (Yuen K Y, Chan P K S, Peiris J S M, et al. Clinical features and rapid viral diagnosis of human disease associated with avian influenza A H5N1 virus. *Lancet* 1998; 351: 467-471). It is important to note that a window of opportunity of around 8 days exists from the onset of symptoms to respiratory failure. Severe complicated cases are strongly associated with both underlying disease and delayed use of ribavirin and steroid therapy. Following our clinical experience in the initial cases, this combination therapy was started very early in subsequent cases which were largely uncomplicated cases at the time of admission. The overall mortality at the time of writing is only 2% with this treatment regimen. There were still 8 out of 19 complicated cases who had not shown significant response. It is not possible to a detail analysis of the therapeutic response to this combination regimen due to the heterogeneous dosing and time of initiation of therapy.

Other factors associated with severe disease is acquisition of the disease through household contact which may be attributed to a higher dose or duration of viral exposure and the presence of underlying diseases.

The clinical description reported here pertains largely to the more severe cases admitted to hospital. We presently have no data on the full clinical spectrum of the emerging Coronaviridae infection in the community or in an out-patient-setting. The availability of diagnostic tests as described here will help address these questions. In addition, it will allow questions pertaining to the period of virus shedding (and communicability) during convalescence, the presence of virus in other body fluids and excreta and the presence of virus shedding during the incubation period, to be addressed.

The epidemiological data at present appears to indicate that the virus is spread by droplets or by direct and indirect contact although airborne spread cannot be ruled out in some instances. The finding of infectious virus in the respiratory tract supports this contention. Preliminary evidence also suggests that the virus may be shed in the feces. However, it is important to note that detection of viral RNA does not prove that the virus is viable or transmissible. If viable virus is detectable in the feces, this would be a potentially additional route of transmission that needs to be considered. It is relevant to note that a number of animal coronaviruses are spread via the fecal-oral route (McIntosh K. Coronaviruses: a comparative review. *Current Top Microbiol Immunol.* 1974; 63: 85-112).

7. Deposit

A sample of isolated hSARS virus was deposited with China Center for Type Culture Collection (CCTCC) at Wuhan University, Wuhan 430072 in China on Apr. 2, 2003 in accordance with the Budapest Treaty on the Deposit of Microorganisms, and accorded accession No. CCTCC-V200303, which is incorporated herein by reference in its entirety.

8. Market Potential

The hSARS virus can now be grown on a large scale, which allows the development of various diagnostic tests as described hereinabove as well as the development of vaccines and antiviral agents that are effective in preventing, ameliorating or treating SARS. Given the severity of the disease and its rapid global spread, it is highly likely that significant demands for diagnostic tests, therapies and vaccines to battle against the disease, will arise on a global scale. In addition, this virus contains genetic information which is extremely important and valuable for clinical and scientific research applications.

9. Equivalents

Those skilled in the art will recognize, or be able to ascertain many equivalents to the specific embodiments of the invention described herein using no more than routine experimentation. Such equivalents are intended to be encompassed by the following claims.

All publications, patents and patent applications mentioned in this specification are herein incorporated by reference into the specification to the same extent as if each individual publication, patent or patent application was specifically and individually indicated to be incorporated herein by reference.

Citation or discussion of a reference herein shall not be construed as an admission that such is prior art to the present invention.

SEQUENCE LISTING (2487 sequences)

SEQ ID NO: 1 - DNA, 646 bp, Human severe acute respiratory syndrome virus
  CDS (2)...(646)
acaggacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaaattcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataaccta

SEQ ID NO: 2 - protein, 215 aa, Human severe acute respiratory syndrome virus
QDAVASKILGLPTQTVDSSQGSEYDYVIFTQTTETAHSCNVNRFNVAITRAKIGILCIMSDRDLYDKLQFTSLEIPRRNVATLQAENVTGLFKDCSKIITGLHPTQAPTHLSVDIKFKTEGLCVDIPGIPKDMTYRRLISMMGFKMNYQVNGYPNMFITREEAIRHVRAWIGFDVEGCHATRDAVGTNLPLQLGFSTGVNLVAVPTGYVDTENNL

SEQ ID NO: 3 - DNA, 17 bp, Artificial Sequence
  primer sequence for RT-PCT based on partial nucleotide sequence of the gemome of hSARS
tacacacctcagcgttg

SEQ ID NO: 4 - DNA, 16 bp, Artificial Sequence
  primer sequence for RT-PCT based on partial nucleotide sequence of the gemome of hSARS
cacgaacgtgacgaat

SEQ ID NO: 5 - DNA, 27 bp, Artificial Sequence
  degenerated primer in Superscript II Kit by Invitrogen
  misc_feature (21)..(27): a, t, c or g
gccggagctctgcagaattcnnnnnnn

SEQ ID NO: 6 - DNA, 20 bp, Artificial Sequence
  primer provided in AmpliTaq Gold Kit by Applied Biosyndromes
gccggagctctgcagaattc

SEQ ID NO: 7 - DNA, 17 bp, Artificial Sequence
  First round of primer for amplifying human metapneumovirus (HMPV)
aargtsaatgcatcagc

SEQ ID NO: 8 - DNA, 20 bp, Artificial Sequence
  first round primer for amplifying human metapneumovirus (HMPV)
cakattytgcttatgctttc

SEQ ID NO: 9 - DNA, 20 bp, Artificial Sequence
  nested primer for amplifying human metapneumovirus (HMPV)
acacctgttacaataccagc

SEQ ID NO: 10 - DNA, 19 bp, Artificial Sequence
  nested primer for amplifying human metapneumovirus (HMPV)
gacttgagtcccagctcca

SEQ ID NO: 11 - DNA, 1213 bp, Human severe acute respiratory syndrome virus
  CDS (2)...(1213)
taaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaaattcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataaccta

SEQ ID NO: 12 - protein, 404 aa, Human severe acute respiratory syndrome virus
KCSRIIPARARVECFDKFKVNSTLEQYVFCTVNALPETTADIVVFDEISMATNYDLSVVNARLRAKHYVYIGDPAQLPAPRTLLTKGTLEPEYFNSVCRLMKTIGPDMFLGTCRRCPAEIVDTVSALVYDNKLKAHKEKSAQCFKMFYKGVITHDVSSAINRPQIGVVREFLTRNPAWRKAVFISPYNSQNAVASKILGLPTQTVDSSQGSEYDYVIFTQTTETAHSCNVNRFNVAITRAKIGILCIMSDRDLYDKLQFTSLEIPRRNVATLQAENVTGLFKDCSKIITGLHPTQAPTHLSVDIKFKTEGLCVDIPGIPKDMTYRRLISMMGFKMNYQVNGYPNMFITREEAIRHVRAWIGFDVEGCHATRDAVGTNLPLQLGFSTGVNLVAVPTGYVDTENNL

SEQ ID NO: 13 - DNA, 729 bp, Human severe acute respiratory syndrome virus
  CDS (2)..(694)
cagaaccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaacagatggtacacttatgattgaaaggttccgtgtcactggctattgatgc

SEQ ID NO: 14 - protein, 231 aa, Human severe acute respiratory syndrome virus
RTMPNMLRIMASLVLARKHNTCCNLSHRFYRLANECAQVLSEMVMCGGSLYVKPGGTSSGDATTAYANSVFNICQAVTANVNALLSTDGNKIADKYVRNLQHRLYECLYRNRDVDHEFVDEFYAYLRKHFSMMILSDDAVVCYNSNYAAQGLVASIKNFKAVLYYQNNVFMSEAKCWTETDLTKGPHEFCSQHTMLVKQGDDYVYLPYPDPSRILGAGCFVDDIVKQMVHL

SEQ ID NO: 15 - DNA, 29742 bp, Human severe acute respiratory syndrome virus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgtcggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcaaacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtactgctgccaagaagaacaacataccttttacactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaaagtgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaaattcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtaaggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaa

SEQ ID NO: 16 - DNA, 29742 bp, Human severe acute respiratory syndrome virus; identical to SEQ ID NO: 15
  CDS (1)..(29742)

SEQ ID NO: 17 - protein, 21 aa, Human severe acute respiratory syndrome virus
ILGFYLPRKSQPTSISCRSVL

SEQ ID NO: 18 - protein, 14 aa, Human severe acute respiratory syndrome virus
TNFKICVAVARLHA

SEQ ID NO: 19 - protein, 5 aa, Human severe acute respiratory syndrome virus
CTYAV

SEQ ID NO: 20 - protein, 40 aa, Human severe acute respiratory syndrome virus
TIINFTVVDKKRVTRPSSADCLRFRPCCSRSSAYLGFVRV

SEQ ID NO: 21 - protein, 4386 aa, Human severe acute respiratory syndrome virus
PKGKMESLVLGVNEKTHVQLSLPVLQVRDVLVRGFGDSVEEALSEAREHLKNGTCGLVELEKGVLPQLEQPYVFIKRSDALSTNHGHKVVELVAEMDGIQYGRSGITLGVLVPHVGETPIAYRNVLLRKNGNKGAGGHSYGIDLKSYDLGDELGTDPIEDYEQNWNTKHGSGALRELTRELNGGAVTRYVDNNFCGPDGYPLDCIKDFLARAGKSMCTLSEQLDYIESKRGVYCCRDHEHEIAWFTERSDKSYEHQTPFEIKSAKKFDTFKGECPKFVFPLNSKVKVIQPRVEKKKTEGFMGRIRSVYPVASPQECNNMHLSTLMKCNHCDEVSWQTCDFLKATCEHCGTENLVIEGPTTCGYLPTNAVVKMPCPACQDPEIGPEHSVADYHNHSNIETRLRKGGRTRCFGGCVFAYVGCYNKRAYWVPRASADIGSGHTGITGDNVETLNEDLLEILSRERVNINIVGDFHLNEEVAIILASFSASTSAFIDTIKSLDYKSFKTIVESCGNYKVTKGKPVKGAWNIGQQRSVLTPLCGFPSQAAGVIRSIFARTLDAANHSIPDLQRAAVTILDGISEQSLRLVDAMVYTSDLLTNSVIIMAYVTGGLVQQTSQWLSNLLGTTVEKLRPIFEWIEAKLSAGVEFLKDAWEILKFLITGVFDIVKGQIQVASDNIKDCVKCFIDVVNKALEMCIDQVTIAGAKLRSLNLGEVFIAQSKGLYRQCIRGKEQLQLLMPLKAPKEVTFLEGDSHDTVLTSEEVVLKNGELEALETPVDSFTNGAIVGTPVCVNGLMLLEIKDKEQYCALSPGLLATNNVFRLKGGAPIKGVTFGEDTVWEVQGYKNVRITFELDERVDKVLNEKCSVYTVESGTEVTEFACVVAEAVVKTLQPVSDLLTNMGIDLDEWSVATFYLFDDAGEENFSSRMYCSFYPPDEEEEDDAECEEEEIDETCEHEYGTEDDYQGLPLEFGASAETVRVEEEEEEDWLDDTTEQSEIEPEPEPTPEEPVNQFTGYLKLTDNVAIKCVDIVKEAQSANPMVIVNAANIHLKHGGGVAGALNKATNGAMQKESDDYIKLNGPLTVGGSCLLSGHNLAKKCLHVVGPNLNAGEDIQLLKAAYENFNSQDILLAPLLSAGIFGAKPLQSLQVCVQTVRTQVYIAVNDKALYEQVVMDYLDNLKPRVEAPKQEEPPNTEDSKTEEKSVVQKPVDVKPKIKACIDEVTTTLEETKFLTNKLLLFADINGKLYHDSQNMLRGEDMSFLEKDAPYMVGDVITSGDITCVVIPSKKAGGTTEMLSRALKKVPVDEYITTYPGQGCAGYTLEEAKTALKKCKSAFYVLPSEAPNAKEEILGTVSWNLREMLAHAEETRKLMPICMDVRAIMATIQRKYKGIKIQEGIVDYGVRFFFYTSKEPVASIITKLNSLNEPLVTMPIGYVTHGFNLEEAARCMRSLKAPAVVSVSSPDAVTTYNGYLTSSSKTSEEHFVETVSLAGSYRDWSYSGQRTELGVEFLKRGDKIVYHTLESPVEFHLDGEVLSLDKLKSLLSLREVKTIKVFTTVDNTNLHTQLVDMSMTYGQQFGPTYLDGADVTKIKPHVNHEGKTFFVLPSDDTLRSEAFEYYHTLDESFLGRYMSALNHTKKWKFPQVGGLTSIKWADNNCYLSSVLLALQQLEVKFNAPALQEAYYRARAGDAANFCALILAYSNKTVGELGDVRETMTHLLQHANLESAKRVLNVVCKHCGQKTTTLTGVEAVMYMGTLSYDNLKTGVSIPCVCGRDATQYLVQQESSFVMMSAPPAEYKLQQGTFLCANEYTGNYQCGHYTHITAKETLYRIDGAHLTKMSEYKGPVTDVFYKETSYTTTIKPVSYKLDGVTYTEIEPKLDGYYKKDNAYYTEQPIDLVPTQPLPNASFDNFKLTCSNTKFADDLNQMTGFTKPASRELSVTFFPDLNGDVVAIDYRHYSASFKKGAKLLHKPIVWHINQATTKTTFKPNTWCLRCLWSTKPVDTSNSFEVLAVEDTQGMDNLACESQQPTSEEVVENPTIQKEVIECDVKTTEVVGNVILKPSDEGVKVTQELGHEDLMAAYVENTSITIKKPNELSLALGLKTIATHGIAAINSVPWSKILAYVKPFLGQAAITTSNCAKRLAQRVFNNYMPYVFTLLFQLCTFTKSTNSRIRASLPTTIAKNSVKSVAKLCLDAGINYVKSPKFSKLFTIAMWLLLLSICLGSLICVTAAFGVLLSNFGAPSYCNGVRELYLNSSNVTTMDFCEGSFPCSICLSGLDSLDSYPALETIQVTISSYKLDLTILGLAAEWVLAYMLFTKFFYLLGLSAIMQVFFGYFASHFISNSWLMWFIISIVQMAPVSAMVRMYIFFASFYYIWKSYVHIMDGCTSSTCMMCYKRNRATRVECTTIVNGMKRSFYVYANGGRGFCKTHNWNCLNCDTFCTGSTFISDEVARDLSLQFKRPINPTDQSSYIVDSVAVKNGALHLYFDKAGQKTYERHPLSHFVNLDNLRANNTKGSLPINVIVFDGKSKCDESASKSASVYYSQLMCQPILLLDQALVSNVGDSTEVSVKMFDAYVDTFSATFSVPMEKLKALVATAHSELAKGVALDGVLSTFVSAARQGVVDTDVDTKDVIECLKLSHHSDLEVTGDSCNNFMLTYNKVENMTPRDLGACIDCNARHINAQVAKSHNVSLIWNVKDYMSLSEQLRKQIRTAAKKNNIPFTLTCATTRQVVNVITTKISLKGGKIVSTCFKLMLKATLLCVLAALVCYIVMPVHTLSIHDGYTNEIIGYKAIQDGVTRDIISTDDCFANKHAGFDAWFSQRGGSYKNDKSCPVVAAIITREIGFIVPGLPGTVLRAINGDFLHFLPRVFSAVGNICYTPSKLIEYSDFATSACVLAAECTIFKDAMGKPVPYCYDTNLLEGSISYSELRPDTRYVLMDGSIIQFPNTYLEGSVRVVTTFDAEYCRHGTCERSEVGICLSTSGRWVLNNEHYRALSGVFCGVDAMNLIANIFTPLVQPVGALDVSASVVAGGIIAILVTCAAYYFMKFRRVFGEYNHVVAANALLFLMSFTILCLVPAYSFLPGVYSVFYLYLTFYFTNDVSFLAHLQWFAMFSPIVPFWITAIYVFCISLKHCHWFFNNYLRKRVMFNGVTFSTFEEAALCTFLLNKEMYLKLRSETLLPLTQYNRYLALYNKYKYFSGALDTTSYREAACCHLAKALNDFSNSGADVLYQPPQTSITSAVLQSGFRKMAFPSGKVEGCMVQVTCGTTTLNGLWLDDTVYCPRHVICTAEDMLNPNYEDLLIRKSNHSFLVQAGNVQLRVIGHSMQNCLLRLKVDTSNPKTPKYKFVRIQPGQTFSVLACYNGSPSGVYQCAMRPNHTIKGSFLNGSCGSVGFNIDYDCVSFCYMHHMELPTGVHAGTDLEGKFYGPFVDRQTAQAAGTDTTITLNVLAWLYAAVINGDRWFLNRFTTTLNDFNLVAMKYNYEPLTQDHVDILGPLSAQTGIAVLDMCAALKELLQNGMNGRTILGSTILEDEFTPFDVVRQCSGVTFQGKFKKIVKGTHHWMLLTFLTSLLILVQSTQWSLFFFVYENAFLPFTLGIMAIAACAMLLVKHKHAFLCLFLLPSLATVAYFNMVYMPASWVMRIMTWLELADTSLSGYRLKDCVMYASALVLLILMTARTVYDDAARRVWTLMNVITLVYKVYYGNALDQAISMWALVISVTSNYSGVVTTIMFLARAIVFVCVEYYPLLFITGNTLQCIMLVYCFLGYCCCCYFGLFCLLNRYFRLTLGVYDYLVSTQEFRYMNSQGLLPPKSSIDAFKLNIKLLGIGGKPCIKVATVQSKMSDVKCTSVVLLSVLQQLRVESSSKLWAQCVQLHNDILLAKDTTEAFEKMVSLLSVLLSMQGAVDINRLCEEMLDNRATLQAIASEFSSLPSYAAYATAQEAYEQAVANGDSEVVLKKLKKSLNVAKSEFDRDAAMQRKLEKMADQAMTQMYKQARSEDKRAKVTSAMQTMLFTMLRKLDNDALNNIINNARDGCVPLNIIPLTTAAKLMVVVPDYGTYKNTCDGNTFTYASALWEIQQVVDADSKIVQLSEINMDNSPNLAWPLIVTALRANSAVKLQNNELSPVALRQMSCAAGTTQTACTDDNALAYYNNSKGGRFVLALLSDHQDLKWARFPKSDGTGTIYTELEPPCRFVTDTPKGPKVKYLYFIKGLNNLNRGMVLGSLAATVRLQAGNATEVPANSTVLSFCAFAVDPAKAYKDYLASGGQPITNCVKMLCTHTGTGQAITVTPEANMDQESFGGASCCLYCRCHIDHPNPKGFCDLKGKYVQIPTTCANDPVGFTLRNTVCTVCGMWKGYGCSCDQLREPLMQSADASTFLNGFAV

SEQ ID NO: 22 - protein, 34 aa, Human severe acute respiratory syndrome virus
VQPVLHRAAQALVLMSSTGLLIFTTKKVLVLQSS

SEQ ID NO: 23 - protein, 16 aa, Human severe acute respiratory syndrome virus
KLIAVASRRRMRKAIY

SEQ ID NO: 24 - protein, 4 aa, Human severe acute respiratory syndrome virus
TLTL

SEQ ID NO: 25 - protein, 34 aa, Human severe acute respiratory syndrome virus
LRGILCLTTNMKRLFITWLKIVQRLLSMTFSSLE

SEQ ID NO: 26 - protein, 12 aa, Human severe acute respiratory syndrome virus
MVTWYHIYHVSV

SEQ ID NO: 27 - protein, 7 aa, Human severe acute respiratory syndrome virus
LNTQWLI

SEQ ID NO: 28 - protein, 14 aa, Human severe acute respiratory syndrome virus
SMLYVILMRVIVIH

SEQ ID NO: 29 - protein, 23 aa, Human severe acute respiratory syndrome virus
KKYSSHTIAVMMIISIRRIGMTS

SEQ ID NO: 30 - protein, 11 aa, Human severe acute respiratory syndrome virus
RILTSYAYMLT

SEQ ID NO: 31 - protein, 8 aa, Human severe acute respiratory syndrome virus
VSVYANHY

SEQ ID NO: 32 - protein, 14 aa, Human severe acute respiratory syndrome virus
RLYNSAMLCVMQAL

SEQ ID NO: 33 - protein, 17 aa, Human severe acute respiratory syndrome virus
IIRILMGTGTISVISYK

SEQ ID NO: 34 - protein, 15 aa, Human severe acute respiratory syndrome virus
HQAAEFLLWIHITHC

SEQ ID NO: 35 - protein, 5 aa, Human severe acute respiratory syndrome virus
CPSSL

SEQ ID NO: 36 - protein, 23 aa, Human severe acute respiratory syndrome virus
LGHWLLSPIWMLISQNHLLSGIC

SEQ ID NO: 37 - protein, 57 aa, Human severe acute respiratory syndrome virus
NMILRKRDFVSSTVILNIGTRHTIPIVLTVWMIGVSFIVQTLMCYFLLCFHLQVLDH

SEQ ID NO: 38 - protein, 4 aa, Human severe acute respiratory syndrome virus
EKYL

SEQ ID NO: 39 - protein, 15 aa, Human severe acute respiratory syndrome virus
MVFLLLFQLDTIFVS

SEQ ID NO: 40 - protein, 7 aa, Human severe acute respiratory syndrome virus
ESYIIRM

SEQ ID NO: 41 - protein, 12 aa, Human severe acute respiratory syndrome virus
TYIARVSVSRNF

SEQ ID NO: 42 - protein, 16 aa, Human severe acute respiratory syndrome virus
CMLLIQLCMQLLAIYC

SEQ ID NO: 43 - protein, 8 aa, Human severe acute respiratory syndrome virus
INALHAFQ

SEQ ID NO: 44 - protein, 35 aa, Human severe acute respiratory syndrome virus
QTMLLFKLSNPVILIKTFMTLLCLKVSLRKEVLLN

SEQ ID NO: 45 - protein, 34 aa, Human severe acute respiratory syndrome virus
NTSSLLRMATLLSVIMTIIVIICQQCVISDNSYS

SEQ ID NO: 46 - protein, 20 aa, Human severe acute respiratory syndrome virus
LKLLINTLIVTMVAVLMPTK

SEQ ID NO: 47 - protein, 25 aa, Human severe acute respiratory syndrome virus
SLTIWINQLVSHLINGVRLDFIMTQ

SEQ ID NO: 48 - protein, 19 aa, Human severe acute respiratory syndrome virus
VMRIKMHFSRILSVMSSLL

SEQ ID NO: 49 - protein, 14 aa, Human severe acute respiratory syndrome virus
ILSMPLVQRIELAP

SEQ ID NO: 50 - protein, 8 aa, Human severe acute respiratory syndrome virus
LVSLSVVL

SEQ ID NO: 51 - protein, 9 aa, Human severe acute respiratory syndrome virus
QIDSFIRNY

SEQ ID NO: 52 - protein, 8 aa, Human severe acute respiratory syndrome virus
PPLEELLW

SEQ ID NO: 53 - protein, 13 aa, Human severe acute respiratory syndrome virus
LEQASFTVAGIIC

SEQ ID NO: 54 - protein, 6 aa, Human severe acute respiratory syndrome virus
KLFTVM

SEQ ID NO: 55 - protein, 22 aa, Human severe acute respiratory syndrome virus
KLHTLWVGIIQNVTEPCLTCLG

SEQ ID NO: 56 - protein, 22 aa, Human severe acute respiratory syndrome virus
WPLLFLLANITLAVTYHTVSTG

SEQ ID NO: 57 - protein, 7 aa, Human severe acute respiratory syndrome virus
LTSVRKY

SEQ ID NO: 58 - protein, 40 aa, Human severe acute respiratory syndrome virus
VRWSCVAAHYMLNQVEHHPVMLQLLMLIVSLTFVKLLQPM

SEQ ID NO: 59 - protein, 10 aa, Human severe acute respiratory syndrome virus
MHFFQLMVIR

SEQ ID NO: 60 - protein, 39 aa, Human severe acute respiratory syndrome virus
LTSMSAIYNTGSMSVSIEIGMLIMNSWMSFTLTCVNISP

SEQ ID NO: 61 - protein, 18 aa, Human severe acute respiratory syndrome virus
FFLMMPLCAITVTMRLKV

SEQ ID NO: 62 - protein, 42 aa, Human severe acute respiratory syndrome virus
LALRTLRQFFIIKIMCSCLRQNVGLRLTLLKDLTNFAHSIQC

SEQ ID NO: 63 - protein, 18 aa, Human severe acute respiratory syndrome virus
LNKEMITCTCLTQIHQEY

SEQ ID NO: 64 - protein, 16 aa, Human severe acute respiratory syndrome virus
AQAVLSMILSKQMVHL

SEQ ID NO: 65 - protein, 49 aa, Human severe acute respiratory syndrome virus
LKGSCHWLLMLTHLQNILIRSMLMSFTCIYNTLESYMMSLLATCWTCIP

SEQ ID NO: 66 - protein, 26 aa, Human severe acute respiratory syndrome virus
LMITPHGTGNLSFMRLCTHHIQSCRL

SEQ ID NO: 67 - protein, 38 aa, Human severe acute respiratory syndrome virus
VLVYCAIHRLHFVAVPVLGDHSYVASAAMTMSFQHHTN

SEQ ID NO: 68 - protein, 18 aa, Human severe acute respiratory syndrome virus
CCLLIPMFAMPQVVMSLM

SEQ ID NO: 69 - protein, 4 aa, Human severe acute respiratory syndrome virus
HNCI

SEQ ID NO: 70 - protein, 29 aa, Human severe acute respiratory syndrome virus
AIIASHISLPLVFHYVLMVRFLVYTKTHV

SEQ ID NO: 71 - protein, 10 aa, Human severe acute respiratory syndrome virus
AVTMSLTSMR

SEQ ID NO: 72 - protein, 66 aa, Human severe acute respiratory syndrome virus
QHVIGLMLAITYLPTLVLRDSSFSQQKRSKPLRKHLSCHMVLPLYAKYSLTENCIFHGRLENLDHH

SEQ ID NO: 73 - protein, 10 aa, Human severe acute respiratory syndrome virus
TETMSLLVTV

SEQ ID NO: 74 - protein, 31 aa, Human severe acute respiratory syndrome virus
LKIVKYRLESTPLKKVTMVMLLCTEVLRHTS

SEQ ID NO: 75 - protein, 7 aa, Human severe acute respiratory syndrome virus
MLVITLC

SEQ ID NO: 76 - protein, 4 aa, Human severe acute respiratory syndrome virus
HLTL

SEQ ID NO: 77 - protein, 7 aa, Human severe acute respiratory syndrome virus
CHLVHLL

SEQ ID NO: 78 - protein, 6 aa, Human severe acute respiratory syndrome virus
CHKSTM

SEQ ID NO: 79 - protein, 56 aa, Human severe acute respiratory syndrome virus
ELLACTQHSTSQMSFLAMLQIIKRSACKSTLHSKDHLVLVRVILPSDLLSITHLLA

SEQ ID NO: 80 - protein, 17 aa, Human severe acute respiratory syndrome virus
CIRHALMQLLMPYVKRH

SEQ ID NO: 81 - protein, 4 aa, Human severe acute respiratory syndrome virus
NICP

SEQ ID NO: 82 - protein, 12 aa, Human severe acute respiratory syndrome virus
INVVESYLRVRA

SEQ ID NO: 83 - protein, 7 aa, Human severe acute respiratory syndrome virus
SVLINSK

SEQ ID NO: 84 - protein, 7 aa, Human severe acute respiratory syndrome virus
NSMFSAL

SEQ ID NO: 85 - protein, 10 aa, Human severe acute respiratory syndrome virus
MHCQKQLLTL

SEQ ID NO: 86 - protein, 12 aa, Human severe acute respiratory syndrome virus
SLMKSLWLLIMT

SEQ ID NO: 87 - protein, 27 aa, Human severe acute respiratory syndrome virus
VLSMLDFVQNTTSILAILLNYQPPAHC

SEQ ID NO: 88 - protein, 4 aa, Human severe acute respiratory syndrome virus
LKAH

SEQ ID NO: 89 - protein, 11 aa, Human severe acute respiratory syndrome virus
NQNILIQCADL

SEQ ID NO: 90 - protein, 19 aa, Human severe acute respiratory syndrome virus
VQTCSLELVAVVLLKLLTL

SEQ ID NO: 91 - protein, 5 aa, Human severe acute respiratory syndrome virus
FMTIS

SEQ ID NO: 92 - protein, 31 aa, Human severe acute respiratory syndrome virus
KHTRISQLNASKCSTKVLLHMMFHLQSTDLK

SEQ ID NO: 93 - protein, 24 aa, Human severe acute respiratory syndrome virus
ENFLHAILLGEKLFLSHLIIHRTL

SEQ ID NO: 94 - protein, 4 aa, Human severe acute respiratory syndrome virus
LQKS

SEQ ID NO: 95 - protein, 48 aa, Human severe acute respiratory syndrome virus
DCLRRLLIHHRVLNMTMSYSHKLLKQHTLVMSTASMWLSQGQKLAFCA

SEQ ID NO: 96 - protein, 14 aa, Human severe acute respiratory syndrome virus
CLIEIFMTNCNLQV

SEQ ID NO: 97 - protein, 14 aa, Human severe acute respiratory syndrome virus
KYHVAMWLHYKQKM

SEQ ID NO: 98 - protein, 26 aa, Human severe acute respiratory syndrome virus
LDFLRTVVRSLLVFILHRHLHTSALI

SEQ ID NO: 99 - protein, 17 aa, Human severe acute respiratory syndrome virus
NSRLKDYVLTYQAYQRT

SEQ ID NO: 100 - protein, 7 aa, Human severe acute respiratory syndrome virus
PTVDSSL

SEQ ID NO: 101 - protein, 4 aa, Human severe acute respiratory syndrome virus
WVSK

SEQ ID NO: 102 - protein, 28 aa, Human severe acute respiratory syndrome virus
ITKSMVTLICLSPAKKLFVTFVRGLALM

SEQ ID NO: 103 - protein, 17 aa, Human severe acute respiratory syndrome virus
RAVMQLEMLWVLTYLSS

SEQ ID NO: 104 - protein, 7 aa, Human severe acute respiratory syndrome virus
DFLQVLT

SEQ ID NO: 105 - protein, 42 aa, Human severe acute respiratory syndrome virus
LYRLVMLTLKITQNSPELMQNLHQVTSLNILYHSCIKACPGM

SEQ ID NO: 106 - protein, 4 aa, Human severe acute respiratory syndrome virus
CVLR

SEQ ID NO: 107 - protein, 7 aa, Human severe acute respiratory syndrome virus
YKCSVIH

SEQ ID NO: 108 - protein, 20 aa, Human severe acute respiratory syndrome virus
KDCQTESCSSFGRMALSLHQ

SEQ ID NO: 109 - protein, 45 aa, Human severe acute respiratory syndrome virus
STLSRLDLKERVVCVTNVQLAFLLHQILMPAGIILWVLTMSITHL

SEQ ID NO: 110 - protein, 34 aa, Human severe acute respiratory syndrome virus
LMFSSGALRVTFRVTMTNIARYMEMHMWLVVMLS

SEQ ID NO: 111 - protein, 18 aa, Human severe acute respiratory syndrome virus
QSMSALLSALIGLLNTLL

SEQ ID NO: 112 - protein, 13 aa, Human severe acute respiratory syndrome virus
GLILLAEKYNTWL

SEQ ID NO: 113 - protein, 28 aa, Human severe acute respiratory syndrome virus
SLHCLLISFQFFMTLEIQRLSSVCLRLK

SEQ ID NO: 114 - protein, 16 aa, Human severe acute respiratory syndrome virus
NGSSTMLSHVVTKLTK

SEQ ID NO: 115 - protein, 45 aa, Human severe acute respiratory syndrome virus
RNSSILMLHITINSLMVFVCFGIVTLIVTQPMQLCVGLTQESCQT

SEQ ID NO: 116 - protein, 11 aa, Human severe acute respiratory syndrome virus
TYQAVMVVVCM

SEQ ID NO: 117 - protein, 17 aa, Human severe acute respiratory syndrome virus
ISMHSTLQLSIKVHLLI

SEQ ID NO: 118 - protein, 19 aa, Human severe acute respiratory syndrome virus
SNCLSFTILIVLVSLMANK

SEQ ID NO: 119 - protein, 19 aa, Human severe acute respiratory syndrome virus
CRILIMFHSNLLRVLHDAI

SEQ ID NO: 120 - protein, 20 aa, Human severe acute respiratory syndrome virus
VVLFADTMQMSTDSTWMHII

SEQ ID NO: 121 - protein, 27 aa, Human severe acute respiratory syndrome virus
FLLDLAYGFTNNLILITCGIHLPGYRV

SEQ ID NO: 122 - protein, 32 aa, Human severe acute respiratory syndrome virus
KMWLIMLLIKDTLMDTPAKHLFPSLIMLFTQR

SEQ ID NO: 123 - protein, 48 aa, Human severe acute respiratory syndrome virus
MVLMWRSLKIRQHFLLMLHLSFGLSVTLNQCQRLRYSIIWVLISLLIL

SEQ ID NO: 124 - protein, 14 aa, Human severe acute respiratory syndrome virus
SGTTKEKPQHMYLQ

SEQ ID NO: 125 - protein, 4 aa, Human severe acute respiratory syndrome virus
VSAQ

SEQ ID NO: 126 - protein, 26 aa, Human severe acute respiratory syndrome virus
LTLPRNLLRVLVLHLLSCLMVEWKDR

SEQ ID NO: 127 - protein, 10 aa, Human severe acute respiratory syndrome virus
TFLETPVMVF

SEQ ID NO: 128 - protein, 7 aa, Human severe acute respiratory syndrome virus
QKVQSKV

SEQ ID NO: 129 - protein, 15 aa, Human severe acute respiratory syndrome virus
HLQRDQHKLASMESH

SEQ ID NO: 130 - protein, 4 aa, Human severe acute respiratory syndrome virus
LENQ

SEQ ID NO: 131 - protein, 9 aa, Human severe acute respiratory syndrome virus
KHSLTTLRK

SEQ ID NO: 132 - protein, 17 aa, Human severe acute respiratory syndrome virus
TALFNSCLKPTLLRAET

SEQ ID NO: 133 - protein, 49 aa, Human severe acute respiratory syndrome virus
RILSPDHKWKLTFSSSLWMNSYSDISSRAMPSNTSFMEISVMDNLAVFI

SEQ ID NO: 134 - protein, 10 aa, Human severe acute respiratory syndrome virus
PSAHKIHHLN

SEQ ID NO: 135 - protein, 9 aa, Human severe acute respiratory syndrome virus
RILSLWTAQ

SEQ ID NO: 136 - protein, 4 aa, Human severe acute respiratory syndrome virus
KITS

SEQ ID NO: 137 - protein, 13 aa, Human severe acute respiratory syndrome virus
QMRKQVHQNVCVL

SEQ ID NO: 138 - protein, 10 aa, Human severe acute respiratory syndrome virus
LIFYLMTLSR

SEQ ID NO: 139 - protein, 6 aa, Human severe acute respiratory syndrome virus
SHKICQ

SEQ ID NO: 140 - protein, 72 aa, Human severe acute respiratory syndrome virus
FQKWSRLQLTMLKFHSCFGVRMDMLKPSTQNYKQVKRGNQVLRCLTCTRCKECFLKSVTFRIMVKMLLYQKE

SEQ ID NO: 141 - protein, 11 aa, Human severe acute respiratory syndrome virus
MSQSILNCVNT

SEQ ID NO: 142 - protein, 4 aa, Human severe acute respiratory syndrome virus
IHLL

SEQ ID NO: 143 - protein, 5 aa, Human severe acute respiratory syndrome virus
LYPTT

SEQ ID NO: 144 - protein, 45 aa, Human severe acute respiratory syndrome virus
ELFTLVLALIKELHQVQLCSDNGCQLAHYLSIQILMTSSPTQILL

SEQ ID NO: 145 - protein, 27 aa, Human severe acute respiratory syndrome virus
LETVQQYIRLINGTLLLAICMTLGPNM

SEQ ID NO: 146 - protein, 17 aa, Human severe acute respiratory syndrome virus
QKRMTLKKGFSLICVDL

SEQ ID NO: 147 - protein, 5 aa, Human severe acute respiratory syndrome virus
PWVVL

SEQ ID NO: 148 - protein, 25 aa, Human severe acute respiratory syndrome virus
QSILGMLTFTSLWAISHGGQLLLQM

SEQ ID NO: 149 - protein, 8 aa, Human severe acute respiratory syndrome virus
MHHHRKHF

SEQ ID NO: 150 - protein, 40 aa, Human severe acute respiratory syndrome virus
LGLTILASRRNKLMAIPCMLTTFSGGTQILSSCLPIHSLT

SEQ ID NO: 151 - protein, 6 aa, Human severe acute respiratory syndrome virus
ANFLLN

SEQ ID NO: 152 - protein, 4 aa, Human severe acute respiratory syndrome virus
EELL

SEQ ID NO: 153 - protein, 10 aa, Human severe acute respiratory syndrome virus
CLLRRIKSMI

SEQ ID NO: 154 - protein, 67 aa, Human severe acute respiratory syndrome virus
FILFWKKVGLSLEKTTELWFQVIFLLTTKRTCLFSYYFLLSLVVVTLTGAPLLMMFKLLITLNILHL

SEQ ID NO: 155 - protein, 16 aa, Human severe acute respiratory syndrome virus
GGFTILMKFLDQTLFI

SEQ ID NO: 156 - protein, 52 aa, Human severe acute respiratory syndrome virus
LRIYFFHFILMLQGFILLIIRLATLSYLLRMVFILLPQRNQMLSVVGFLVLP

SEQ ID NO: 157 - protein, 6 aa, Human severe acute respiratory syndrome virus
TTSHSR

SEQ ID NO: 158 - protein, 36 aa, Human severe acute respiratory syndrome virus
LLLTILLMLLYEHVTLNCVTTLSLLFLNPWVHRHIL

SEQ ID NO: 159 - protein, 51 aa, Human severe acute respiratory syndrome virus
YSIMHLIALSSTYLMPFRLMFQKSQVILNTYESLCLKIKMGFSMFIRAINL

SEQ ID NO: 160 - protein, 10 aa, Human severe acute respiratory syndrome virus
FVIYLLVLTL

SEQ ID NO: 161 - protein, 40 aa, Human severe acute respiratory syndrome virus
NLFLSCLLVLTLQILEPFLQPFHLLKTFGARQLQPILLAI

SEQ ID NO: 162 - protein, 56 aa, Human severe acute respiratory syndrome virus
SQLHLCSSMMKMVQSQMLLIVLKIHLLNSNALLRALRLTKEFTRPLISGLFPQEML

SEQ ID NO: 163 - protein, 59 aa, Human severe acute respiratory syndrome virus
DSLILQTCVLLERFLMLLNSLLSMHGREKKFLIVLLITLCSTTQHFFQPLSAMAFLPLS

SEQ ID NO: 164 - protein, 13 aa, Human severe acute respiratory syndrome virus
MIFASPMSMQILL

SEQ ID NO: 165 - protein, 5 aa, Human severe acute respiratory syndrome virus
SREMM

SEQ ID NO: 166 - protein, 80 aa, Human severe acute respiratory syndrome virus
RQDKLVLLLIIIINCQMISWVVSLLGILGTLMLLQLVIIIINIGILDMASLGPLRETYLMCLSPLMANLAPHLLLIVIGH

SEQ ID NO: 167 - protein, 18 aa, Human severe acute respiratory syndrome virus
MIMVFTPLLALATNLTEL

SEQ ID NO: 168 - protein, 6 aa, Human severe acute respiratory syndrome virus
YFLLNF

SEQ ID NO: 169 - protein, 33 aa, Human severe acute respiratory syndrome virus
MHRPRFVDQNYPLTLLRTSVSILILMDSLVLVC

SEQ ID NO: 170 - protein, 32 aa, Human severe acute respiratory syndrome virus
LLLQRDFNHFNNLAVMFLISLIPFEILKHLKY

SEQ ID NO: 171 - protein, 9 aa, Human severe acute respiratory syndrome virus
TFHLALLGV

SEQ ID NO: 172 - protein, 53 aa, Human severe acute respiratory syndrome virus
LHLEQMLHLKLLFYIKMLTALMFLQQFMQINSHQLGAYILLETMYSRLKQAVL

SEQ ID NO: 173 - protein, 43 aa, Human severe acute respiratory syndrome virus
ELSMSTLLMSATFLLELAFVLVTIQFLYYVVLAKNLLWLILCL

SEQ ID NO: 174 - protein, 26 aa, Human severe acute respiratory syndrome virus
VLIVQLLTLITPLLYLLTFQLALLQK

SEQ ID NO: 175 - protein, 9 aa, Human severe acute respiratory syndrome virus
CLFLWLKPP

SEQ ID NO: 176 - protein, 26 aa, Human severe acute respiratory syndrome virus
IVICTSAEILLNVLICFSNMVAFAHN

SEQ ID NO: 177 - protein, 30 aa, Human severe acute respiratory syndrome virus
IVHSQVLLLNRIATHVKCSLKSNKCTKPQL

SEQ ID NO: 178 - protein, 15 aa, Human severe acute respiratory syndrome virus
NILVVLIFHKYYLTL

SEQ ID NO: 179 - protein, 15 aa, Human severe acute respiratory syndrome virus
SQLRGLLLRTCSLIR

SEQ ID NO: 180 - protein, 7 aa, Human severe acute respiratory syndrome virus
HSLMLAS

SEQ ID NO: 181 - protein, 6 aa, Human severe acute respiratory syndrome virus
SNMANA

SEQ ID NO: 182 - protein, 27 aa, Human severe acute respiratory syndrome virus
VILMLEISFVRRSSMDLQCCHLCSLMI

SEQ ID NO: 183 - protein, 7 aa, Human severe acute respiratory syndrome virus
LLPTLLL

SEQ ID NO: 184 - protein, 81 aa, Human severe acute respiratory syndrome virus
LVVLPLLDGHLVLALLFKYLLLCKWHIGSMALELPKMFSMRTKNKSPTNLTRRLVKFKNHLQQHQLHWASCKTLLTRMLKH

SEQ ID NO: 185 - protein, 17 aa, Human severe acute respiratory syndrome virus
THLLNNLALILVQFQVC

SEQ ID NO: 186 - protein, 18 aa, Human severe acute respiratory syndrome virus
MISFRDLIKSRRRYKLTG

SEQ ID NO: 187 - protein, 11 aa, Human severe acute respiratory syndrome virus
LQADFKAFKPM

SEQ ID NO: 188 - protein, 101 aa, Human severe acute respiratory syndrome virus
SGLLKSGLLLILLLLKCLSVFLDNQKELTFVERATTLCPSHKQPRMVLSSYMSRMCHPRRGTSPQRQQFVMKAKHTSLVKVFLCLMALLGLLHRGTSFLHK

SEQ ID NO: 189 - protein, 78 aa, Human severe acute respiratory syndrome virus
LLQTIHLSQEIVMSLLASLTTQFMILCNLSLTHSKKSWTSTSKIIHHQMLILATFQALTLLSSTFKKKLTASMRSLKI

SEQ ID NO: 190 - protein, 30 aa, Human severe acute respiratory syndrome virus
MNHSLTFKNWENMSNILNGLGMFGSASLLD

SEQ ID NO: 191 - protein, 12 aa, Human severe acute respiratory syndrome virus
LPSSWLQSCFVA

SEQ ID NO: 192 - protein, 59 aa, Human severe acute respiratory syndrome virus
LVVAVASRVHALVVLAASLMRMTLSQFSRVSNYITHKRTYGFVYEIFYSWINYCTASKN

SEQ ID NO: 193 - protein, 45 aa, Human severe acute respiratory syndrome virus
QCFSCKYCSCYSNDTATSLTPFRMACYWRCISCCFSERYQNNCAQ

SEQ ID NO: 194 - protein, 7 aa, Human severe acute respiratory syndrome virus
KMAASPL

SEQ ID NO: 195 - protein, 25 aa, Human severe acute respiratory syndrome virus
GLPVHLQFTAAICYHLFTSFACRCR

SEQ ID NO: 196 - protein, 20 aa, Human severe acute respiratory syndrome virus
GGAIFVPLCLDIFSTMHQRM

SEQ ID NO: 197 - protein, 19 aa, Human severe acute respiratory syndrome virus
NYYEMLALLEVQIQEPITL

SEQ ID NO: 198 - protein, 10 aa, Human severe acute respiratory syndrome virus
CQLLCLLAHT

SEQ ID NO: 199 - protein, 5 aa, Human severe acute respiratory syndrome virus
LLYTI

SEQ ID NO: 200 - protein, 9 aa, Human severe acute respiratory syndrome virus
QCHRYNCRY

SEQ ID NO: 201 - protein, 17 aa, Human severe acute respiratory syndrome virus
RHFNTKTQRRLPNWWLF

SEQ ID NO: 202 - protein, 4 aa, Human severe acute respiratory syndrome virus
ALRC

SEQ ID NO: 203 - protein, 16 aa, Human severe acute respiratory syndrome virus
RLCRCTWLFHRSLLPA

SEQ ID NO: 204 - protein, 10 aa, Human severe acute respiratory syndrome virus
VYTNYYRHWY

SEQ ID NO: 205 - protein, 7 aa, Human severe acute respiratory syndrome virus
KCYILHL

SEQ ID NO: 206 - protein, 17 aa, Human severe acute respiratory syndrome virus
RPTECANTHNRRLFRSC

SEQ ID NO: 207 - protein, 7 aa, Human severe acute respiratory syndrome virus
SSNGSNL

SEQ ID NO: 208 - protein, 5 aa, Human severe acute respiratory syndrome virus
ADDDY

SEQ ID NO: 209 - protein, 8 aa, Human severe acute respiratory syndrome virus
RAFVSTRK

SEQ ID NO: 210 - protein, 17 aa, Human severe acute respiratory syndrome virus
VRTYVLIRFGRNRYVNS

SEQ ID NO: 211 - protein, 31 aa, Human severe acute respiratory syndrome virus
RTSFSCFRGILASHTSHPYCASIVCVLLQYC

SEQ ID NO: 212 - protein, 14 aa, Human severe acute respiratory syndrome virus
REFSKTNGLRLLAC

SEQ ID NO: 213 - protein, 5 aa, Human severe acute respiratory syndrome virus
KSELF

SEQ ID NO: 214 - protein, 242 aa, Human severe acute respiratory syndrome virus
SSGLNELTIIIILFGTLTLLIMADNGTITVEELKQLLEQWNLVIGFLFLAWIMLLQFAYSNRNRFLYIIKLVFLWLLWPVTLACFVLAVVYRINWVTGGIAIAMACIVGLMWLSYFVASFRLFARTRSMWSFNPETNILLNVPLRGTIVTRPLMESELVIGAVIIRGHLRMAGHSLGRCDIKDLPKEITVATSRTLSYYKLGASQRVGTDSGFAAYNRYRIGNYKLNTDHAGSNDNIALLVQ

SEQ ID NO: 215 - protein, 8 aa, Human severe acute respiratory syndrome virus
VTTDVSSC

SEQ ID NO: 216 - protein, 23 aa, Human severe acute respiratory syndrome virus
LPGYNSRDIDYHYEDFQDCYLES

SEQ ID NO: 217 - protein, 11 aa, Human severe acute respiratory syndrome virus
RYNKFNSETII

SEQ ID NO: 218 - protein, 7 aa, Human severe acute respiratory syndrome virus
EELFGVR

SEQ ID NO: 219 - protein, 12 aa, Human severe acute respiratory syndrome virus
RTYGVRLSIKRT

SEQ ID NO: 220 - protein, 5 aa, Human severe acute respiratory syndrome virus
KLFSS

SEQ ID NO: 221 - protein, 21 aa, Human severe acute respiratory syndrome virus
LYLHLASYITIRSVLEVRLYY

SEQ ID NO: 222 - protein, 24 aa, Human severe acute respiratory syndrome virus
KNLAHQEHTRAIHHFTLLLTINLH

SEQ ID NO: 223 - protein, 51 aa, Human severe acute respiratory syndrome virus
LALAHTLLLLVLTVLDIPISCVQDQFHQNFSSDKRRFNKSSTRHFFSLLLL

SEQ ID NO: 224 - protein, 12 aa, Human severe acute respiratory syndrome virus
YFASPLRERQNE

SEQ ID NO: 225 - protein, 4 aa, Human severe acute respiratory syndrome virus
AHFN

SEQ ID NO: 226 - protein, 64 aa, Human severe acute respiratory syndrome virus
LLFVLFSLSAIPCFNNAYYILVFTRNPGSRRTLYQSLNEHETSHCFDLYFSMQLHMHCSTALCI

SEQ ID NO: 227 - protein, 4 aa, Human severe acute respiratory syndrome virus
TSCA

SEQ ID NO: 228 - protein, 16 aa, Human severe acute respiratory syndrome virus
GTTLGVILIALLGFVL

SEQ ID NO: 229 - protein, 32 aa, Human severe acute respiratory syndrome virus
ERFYLFIDGTLWFKHAHLMLLSTVKIQLVVRL

SEQ ID NO: 230 - protein, 21 aa, Human severe acute respiratory syndrome virus
LGVGTFMKVTKLLHLETYLLF

SEQ ID NO: 231 - protein, 428 aa, Human severe acute respiratory syndrome virus
INEQIKMSDNGPQSNQRSAPRITFGGPTDSTDNNQNGGRNGARPKQRRPQGLPNNTASWFTALTQHGKEELRFPRGQGVPINTNSGPDDQIGYYRRATRRVRGGDGKMKELSPRWYFYYLGTGPEASLPYGANKEGIVWVATEGALNTPKDHIGTRNPNNNAATVLQLPQGTTLPKGFYAEGSRGGSQASSRSSSRSRGNSRNSTPGSSRGNSPARMASGGGETALALLLLDRLNQLESKVSGKGQQQQGQTVTKKSAAEASKKPRQKRTATKQYNVTQAFGRRGPEQTQGNFGDQDLIRQGTDYKHWPQIAQFAPSASAFFGMSRIGMEVTPSGTWLTYHGAIKLDDKDPQFKDNVILLNKHIDAYKTFPPTEPKKDKKKKTDEAQPLPQRQKKQPTVTLLPAADMDDFSRQLQNSMSGASADSTQA

SEQ ID NO: 232 - protein, 12 aa, Human severe acute respiratory syndrome virus
TLMMTTQGRWAM

SEQ ID NO: 233 - protein, 16 aa, Human severe acute respiratory syndrome virus
TFSQFRLRYIVYSCAE

SEQ ID NO: 234 - protein, 8 aa, Human severe acute respiratory syndrome virus
ILVTKQHK

SEQ ID NO: 235 - protein, 9 aa, Human severe acute respiratory syndrome virus
LTLISHSNL

SEQ ID NO: 236 - protein, 28 aa, Human severe acute respiratory syndrome virus
SMCNIREDLKEPPHFHRGHAEYDRGYSE

SEQ ID NO: 237 - protein, 11 aa, Human severe acute respiratory syndrome virus
GELPIWKSPNV

SEQ ID NO: 238 - protein, 10 aa, Human severe acute respiratory syndrome virus
CYPHVILIAS

SEQ ID NO: 239 - protein, 8 aa, Human severe acute respiratory syndrome virus
ENDKKKKK

SEQ ID NO: 240 - DNA, 29742 bp, Human severe acute respiratory syndrome virus; identical to SEQ ID NO: 15
  CDS (2)..(29740)

SEQ ID NO: 241 - protein, 26 aa, Human severe acute respiratory syndrome virus
VFTYPGKANQPRSLVDLFSKRTLKSV

SEQ ID NO: 242 - protein, 15 aa, Human severe acute respiratory syndrome virus
LSLGCMPSAPTQYKQ

SEQ ID NO: 243 - protein, 9 aa, Human severe acute respiratory syndrome virus
ILLSLTRNE

SEQ ID NO: 244 - protein, 21 aa, Human severe acute respiratory syndrome virus
LVPLLQTAYGFVRVAVDHQHT

SEQ ID NO: 245 - protein, 36 aa, Human severe acute respiratory syndrome virus
VSSGCDRKVRWRALFLVSTRKHTSNSVCLSFRLETC

SEQ ID NO: 246 - protein, 25 aa, Human severe acute respiratory syndrome virus
CVASGTLWKRPYRRHVNTSKMALVV

SEQ ID NO: 247 - protein, 22 aa, Human severe acute respiratory syndrome virus
SWKKAYCPSLNSPMCSLNVLMP

SEQ ID NO: 248 - protein, 24 aa, Human severe acute respiratory syndrome virus
APITATRSLSWLQKWTAFSTVVAV

SEQ ID NO: 249 - protein, 37 aa, Human severe acute respiratory syndrome virus
HWEYSCHMWAKPQLHTAMFFFVRTVIREPVVIAMASI

SEQ ID NO: 250 - protein, 4 aa, Human severe acute respiratory syndrome virus
SLMT

SEQ ID NO: 251 - protein, 174 aa, Human severe acute respiratory syndrome virus
VTSLALIPLKIMNKTGTLSMAVVHSVNSLVSSMEVQSLAMSTTISVAQMGTLLIASKIFSHARASQCALFPNNLITSSRREVSTAAVTMSMKLPGSLSALIRATSTRHPSKLRVPRNLTLSKGNAQSLCFLLTQKSKSFNHVLKRKRLRVSWGVYALCTLLHLHRSVTICTCLP

SEQ ID NO: 252 - protein, 15 aa, Human severe acute respiratory syndrome virus
NVIIAMKFHGRRATF

SEQ ID NO: 253 - protein, 11 aa, Human severe acute respiratory syndrome virus
KPLVNIVALKI

SEQ ID NO: 254 - protein, 15 aa, Human severe acute respiratory syndrome virus
LLKDLLHVGTYLLML

SEQ ID NO: 255 - protein, 79 aa, Human severe acute respiratory syndrome virus
KCHVLPVKTQRLDLSIVLQIITTTQTLKLDSAREVGLDVLEAVCLPMLAAIISVPTGFLVLVLILAQAILALLVTMWRP

SEQ ID NO: 256 - protein, 7 aa, Human severe acute respiratory syndrome virus
MRISLRY

SEQ ID NO: 257 - protein, 14 aa, Human severe acute respiratory syndrome virus
VVNVLTLTLLAIFI

SEQ ID NO: 258 - protein, 21 aa, Human severe acute respiratory syndrome virus
MKRLPSFWHLSLLLQVPLLTL

SEQ ID NO: 259 - protein, 25 aa, Human severe acute respiratory syndrome virus
RVLITSLSKPLLSPAVTIKLPRESP

SEQ ID NO: 260 - protein, 12 aa, Human severe acute respiratory syndrome virus
KVLGTLDNRDQF

SEQ ID NO: 261 - protein, 70 aa, Human severe acute respiratory syndrome virus
HHCVVFPHRLLVLSDQFLRAHLMQQTTQFLICKEQLSPYLMVFLNSHYVLSTPWFILQTCSPTVSLLWHM

SEQ ID NO: 262 - protein, 73 aa, Human severe acute respiratory syndrome virus
LVVLYNRLLSGCLIFWALLLKNSGLSLNGLRRNLVQELNFSRMLGRFSNFSLQVFLTSSRVKYRLLQITSRIV

SEQ ID NO: 263 - protein, 29 aa, Human severe acute respiratory syndrome virus
NASLMLLTRHSKCALIKSLSLAQSCDHST

SEQ ID NO: 264 - protein, 33 aa, Human severe acute respiratory syndrome virus
VKSSSLKARDFTVSVYVARSSCNYSCLLRHQKK

SEQ ID NO: 265 - protein, 45 aa, Human severe acute respiratory syndrome virus
PFLKVIHMTQYLPLRRLFSRTVNSKHSRRPLIASQMELSSAHQSV

SEQ ID NO: 266 - protein, 5 aa, Human severe acute respiratory syndrome virus
MASCS

SEQ ID NO: 267 - protein, 23 aa, Human severe acute respiratory syndrome virus
RLRTKNNTAHCLLVYWLQTMSFA

SEQ ID NO: 268 - protein, 8 aa, Human severe acute respiratory syndrome virus
KGVHQLKV

SEQ ID NO: 269 - protein, 15 aa, Human severe acute respiratory syndrome virus
PLEKILFGKFKVTRM

SEQ ID NO: 270 - protein, 35 aa, Human severe acute respiratory syndrome virus
ESHLSLMNVLTKCLMKSALSTLLNPVPKLLSLHVL

SEQ ID NO: 271 - protein, 4 aa, Human severe acute respiratory syndrome virus
QRLL

SEQ ID NO: 272 - protein, 21 aa, Human severe acute respiratory syndrome virus
RLYNQFLISLPTWVLILMSGV

SEQ ID NO: 273 - protein, 106 aa, Human severe acute respiratory syndrome virus
LHSTYLMMLVKKTFHHVCIVPFTLQMRKKRTMQSVRKKKLMKPVNMSTVQRMIIKVSLWNLVPQLKQFELRKKKRKTGWMILLSNQRLSQNQNLHLKNQLISLLVI

SEQ ID NO: 274 - protein, 23 aa, Human severe acute respiratory syndrome virus
NLLTMLPLNVLTSLRRHKVLILW

SEQ ID NO: 275 - protein, 6 aa, Human severe acute respiratory syndrome virus
MLLTYT

SEQ ID NO: 276 - protein, 5 aa, Human severe acute respiratory syndrome virus
NMVVV

SEQ ID NO: 277 - protein, 21 aa, Human severe acute respiratory syndrome virus
QVHSTRQPMVPCKRRVMITLS

SEQ ID NO: 278 - protein, 5 aa, Human severe acute respiratory syndrome virus
MALLQ

SEQ ID NO: 279 - protein, 22 aa, Human severe acute respiratory syndrome virus
EGLVCFLDIILLRSVCMLLDLT

SEQ ID NO: 280 - protein, 71 aa, Human severe acute respiratory syndrome virus
MQVRTSSFLRQHMKISIHRTSYLHHCCQQAYLVLNHFSLYKCACRRFVHRFILQSMTKLFMSRLSWIILIT

SEQ ID NO: 281 - protein, 31 aa, Human severe acute respiratory syndrome virus
SLEWKHLNKRSHQTQKIPKLRRNLSYRSLSM

SEQ ID NO: 282 - protein, 58 aa, Human severe acute respiratory syndrome virus
SQKLRPALMRLPQHWKKLSFLPISYSCLLISMVSFTMILRTCLEVKICLSLRRMHLTW

SEQ ID NO: 283 - protein, 12 aa, Human severe acute respiratory syndrome virus
VMLSLVVISLVL

SEQ ID NO: 284 - protein, 16 aa, Human severe acute respiratory syndrome virus
YPPKRLVALLRCSQEL

SEQ ID NO: 285 - protein, 8 aa, Human severe acute respiratory syndrome virus
RKCQLMSI

SEQ ID NO: 286 - protein, 41 aa, Human severe acute respiratory syndrome virus
PRTLDKDVLVIHLRKLRLLLRNANLHFMYYLQKHLMLRKRF

SEQ ID NO: 287 - protein, 6 aa, Human severe acute respiratory syndrome virus
ELYPGI

SEQ ID NO: 288 - protein, 12 aa, Human severe acute respiratory syndrome virus
EKCLLMLKRQEN

SEQ ID NO: 289 - protein, 9 aa, Human severe acute respiratory syndrome virus
CLYAWMLEP

SEQ ID NO: 290 - protein, 32 aa, Human severe acute respiratory syndrome virus
WQPSNVSIKELKFKRASLTMVSDSSFILVKSL

SEQ ID NO: 291 - protein, 6 aa, Human severe acute respiratory syndrome virus
LLLLRS

SEQ ID NO: 292 - protein, 11 aa, Human severe acute respiratory syndrome virus
MSRLSQCQLVM

SEQ ID NO: 293 - protein, 20 aa, Human severe acute respiratory syndrome virus
HMVLILKRLRAVCVLLKLLP

SEQ ID NO: 294 - protein, 27 aa, Human severe acute respiratory syndrome virus
CQYHHQMLLLHIMDTSLRHQRHLRSTL

SEQ ID NO: 295 - protein, 20 aa, Human severe acute respiratory syndrome virus
KQFLWLALTEIGPIQDSVQS

SEQ ID NO: 296 - protein, 33 aa, Human severe acute respiratory syndrome virus
VLNFLSVVTKLCTTLWRAPSSFILTVRFFHLTN

SEQ ID NO: 297 - protein, 11 aa, Human severe acute respiratory syndrome virus
RVSYPCGRLRL

SEQ ID NO: 298 - protein, 19 aa, Human severe acute respiratory syndrome virus
KCSQLWTTLISTHSLWICL

SEQ ID NO: 299 - protein, 22 aa, Human severe acute respiratory syndrome virus
HMDSSLVQHTWMVLMLQKLNLM

SEQ ID NO: 300 - protein, 38 aa, Human severe acute respiratory syndrome virus
IMRVRLSLYYLVMTHYVVKLSSTTILLMRVFLVGTCLL

SEQ ID NO: 301 - protein, 13 aa, Human severe acute respiratory syndrome virus
TTQRNGNFLKLVV

SEQ ID NO: 302 - protein, 16 aa, Human severe acute respiratory syndrome virus
LQLNGLITIVICLVFY

SEQ ID NO: 303 - protein, 50 aa, Human severe acute respiratory syndrome virus
HFNSLKSNSMHQHFKRLIIEPVLVMLLTFVHSYSLTVIKLLASLVMSEKL

SEQ ID NO: 304 - protein, 29 aa, Human severe acute respiratory syndrome virus
PIFYSMLIWNLQSEFLMWCVNIVVRKLLP

SEQ ID NO: 305 - protein, 28 aa, Human severe acute respiratory syndrome virus
CIWVLYLMIILRQVFPFHVCVVVMLHNI

SEQ ID NO: 306 - protein, 8 aa, Human severe acute respiratory syndrome virus
YNKSLLLL

SEQ ID NO: 307 - protein, 32 aa, Human severe acute respiratory syndrome virus
CLHHLLSINYSKVHSYVRMSTLVTISVVITLI

SEQ ID NO: 308 - protein, 23 aa, Human severe acute respiratory syndrome virus
LLRRPSIVLTELTLQRCQSTKDQ

SEQ ID NO: 309 - protein, 48 aa, Human severe acute respiratory syndrome virus
LMFSTRKHLTLQPSSLCRINSMELLTQRLNQNWMGIIKRIMLTIQSSL

SEQ ID NO: 310 - protein, 28 aa, Human severe acute respiratory syndrome virus
TLYQLNHYQMRVLIISNSHVLTQNLLMI

SEQ ID NO: 311 - protein, 18 aa, Human severe acute respiratory syndrome virus
QASQSQLHESYLSHSSQT

SEQ ID NO: 312 - protein, 51 aa, Human severe acute respiratory syndrome virus
WLLTIDTIQRVSRKVLNYCISQLFGTLTRLQPRQRSNQTLGVYVVFGVQSQ

SEQ ID NO: 313 - protein, 10 aa, Human severe acute respiratory syndrome virus
ILQIHLKFWQ

SEQ ID NO: 314 - protein, 20 aa, Human severe acute respiratory syndrome virus
KTHKEWTILLVKVNNPPLKK

SEQ ID NO: 315 - protein, 10 aa, Human severe acute respiratory syndrome virus
WKILPYRRKS

SEQ ID NO: 316 - protein, 5 aa, Human severe acute respiratory syndrome virus
KLPKL

SEQ ID NO: 317 - protein, 13 aa, Human severe acute respiratory syndrome virus
AMSYLNHQMKVLK

SEQ ID NO: 318 - protein, 24 aa, Human severe acute respiratory syndrome virus
VMRILWLLMWKTQALPLRNLMSFH

SEQ ID NO: 319 - protein, 26 aa, Human severe acute respiratory syndrome virus
KQLPLMVLLQLIVFLGVKFWLMSNHS

SEQ ID NO: 320 - protein, 13 aa, Human severe acute respiratory syndrome virus
DKQQLQHQIALRD

SEQ ID NO: 321 - protein, 57 aa, Human severe acute respiratory syndrome virus
HNVCLTIICLMCLHYCSNCVLLLKVPILELELHYLQLLLKIVLRVLLNYVWMPALIM

SEQ ID NO: 322 - protein, 17 aa, Human severe acute respiratory syndrome virus
SHPNFLNCSQSLCGYCC

SEQ ID NO: 323 - protein, 45 aa, Human severe acute respiratory syndrome virus
LLLLVYSYLILVLLLIVMALENCILIRLTLLLWISVKVLFLAAFV

SEQ ID NO: 324 - protein, 13 aa, Human severe acute respiratory syndrome virus
TPLILIQLLKPFR

SEQ ID NO: 325 - protein, 6 aa, Human severe acute respiratory syndrome virus
RFHRTS

SEQ ID NO: 326 - protein, 19 aa, Human severe acute respiratory syndrome virus
VWPLSGFWHICCSQNSFIY

SEQ ID NO: 327 - protein, 4 aa, Human severe acute respiratory syndrome virus
VFQL

SEQ ID NO: 328 - protein, 63 aa, Human severe acute respiratory syndrome virus
CRCSLAILLVISSAILGSCGLSLVLYKWHPFLQWLGCTSSLLLSTTYGRAMFISWMVAPLRLA

SEQ ID NO: 329 - protein, 19 aa, Human severe acute respiratory syndrome virus
CAISAIVPHALSVQLLLMA

SEQ ID NO: 330 - protein, 65 aa, Human severe acute respiratory syndrome virus
RDLSMSMQMEAVASARLTIGIVSIVTHFALVVHSLVMKLLVICHSSLKDQSTLLTSHRILLIVLL

SEQ ID NO: 331 - protein, 27 aa, Human severe acute respiratory syndrome virus
KMARFTSTLTRLVKRPMRDIRSPILSI

SEQ ID NO: 332 - protein, 13 aa, Human severe acute respiratory syndrome virus
ELTTLKVHCLLMS

SEQ ID NO: 333 - protein, 22 aa, Human severe acute respiratory syndrome virus
FLMASPNATSLLLSLLLCTTVS

SEQ ID NO: 334 - protein, 55 aa, Human severe acute respiratory syndrome virus
CANLFCCLTKLLYQTLEIVLKFPLRCLMLMSTPFQQLLVFLWKNLRHLLLQLTAS

SEQ ID NO: 335 - protein, 36 aa, Human severe acute respiratory syndrome virus
MVSFLHSCQLPDKVLLIPMLTQRMLLNVSNFHITLT

SEQ ID NO: 336 - protein, 17 aa, Human severe acute respiratory syndrome virus
QVTVVTISCSPIIRLKT

SEQ ID NO: 337 - protein, 19 aa, Human severe acute respiratory syndrome virus
RPEILAHVLTVMQGISMPK

SEQ ID NO: 338 - protein, 11 aa, Human severe acute respiratory syndrome virus
QKVTMFHSSGM

SEQ ID NO: 339 - protein, 26 aa, Human severe acute respiratory syndrome virus
KTTCLYLNSCVNKFVLLPRRTTYLLH

SEQ ID NO: 340 - protein, 11 aa, Human severe acute respiratory syndrome virus
LVLQLDRLSMS

SEQ ID NO: 341 - protein, 98 aa, Human severe acute respiratory syndrome virus
LLKSHSRVVRLLVLVLNLCLRPHYCAFLLHWFVISLCQYIHCQSMMVTQMKSLVTKPFRMVSLVTSFLLMIVLQINMLVLTHGLASVVVHTKMTKAAL

SEQ ID NO: 342 - protein, 10 aa, Human severe acute respiratory syndrome virus
LLSLQERLVS

SEQ ID NO: 343 - protein, 8 aa, Human severe acute respiratory syndrome virus
CLAYRVLC

SEQ ID NO: 344 - protein, 64 aa, Human severe acute respiratory syndrome virus
EQSMVTSCIFYLVFLVLLATFATHLPNSLSIVILLPLLAFLLLSVQFLRMLWANLCHIVMTLIC

SEQ ID NO: 345 - protein, 35 aa, Human severe acute respiratory syndrome virus
RVLFLIVSFVQTLVMCLWMVPSYSFLTLTWRVLLE

SEQ ID NO: 346 - protein, 17 aa, Human severe acute respiratory syndrome virus
QLLMLSTVDMVHAKGQK

SEQ ID NO: 347 - protein, 29 aa, Human severe acute respiratory syndrome virus
VFAYLPVVDGFLIMSITELYQEFSVVLMR

SEQ ID NO: 348 - protein, 13 aa, Human severe acute respiratory syndrome virus
LTSLLLLCNLWVL

SEQ ID NO: 349 - protein, 5 aa, Human severe acute respiratory syndrome virus
MCLLQ

SEQ ID NO: 350 - protein, 9 aa, Human severe acute respiratory syndrome virus
WLVVLLPYW

SEQ ID NO: 351 - protein, 7 aa, Human severe acute respiratory syndrome virus
LVLPTTL

SEQ ID NO: 352 - protein, 20 aa, Human severe acute respiratory syndrome virus
NSDVFLVSTTMLLLLMHFCF

SEQ ID NO: 353 - protein, 25 aa, Human severe acute respiratory syndrome virus
CLSLYSVWYQLTAFCRESTQSFTCT

SEQ ID NO: 354 - protein, 27 aa, Human severe acute respiratory syndrome virus
HSISPMMFHSWLTFNGLPCFLLLCLFG

SEQ ID NO: 355 - protein, 9 aa, Human severe acute respiratory syndrome virus
QQSMYSVFL

SEQ ID NO: 356 - protein, 40 aa, Human severe acute respiratory syndrome virus
STAIGSLTTILGKESCLMELHLVPSRRLLCVPFCSTRKCT

SEQ ID NO: 357 - protein, 29 aa, Human severe acute respiratory syndrome virus
NCVARHCCHLHSITGILLYITSTSISVEP

SEQ ID NO: 358 - protein, 12 aa, Human severe acute respiratory syndrome virus
ILPAIVKQLAAT

SEQ ID NO: 359 - protein, 44 aa, Human severe acute respiratory syndrome virus
MTLATQVLMFSTNHHRHQSLLLFCRVVLGKWHSRQAKLKGAWYK

SEQ ID NO: 360 - protein, 94 aa, Human severe acute respiratory syndrome virus
PVELQLLMDCGWMTQYTVQDMSFAQQKTCLILTMKICSFANPTIAFLFRLAMFNFVLLAILCKIVCLGLKLILLTLRHPSINLSVSNLVKHFQF

SEQ ID NO: 361 - protein, 14 aa, Human severe acute respiratory syndrome virus
HATMVHHLVFISVP

SEQ ID NO: 362 - protein, 46 aa, Human severe acute respiratory syndrome virus
DLIIPLKVLSLMDHVVVLVLTLIMIACLSAICIIWSFQQEYTLVLT

SEQ ID NO: 363 - protein, 22 aa, Human severe acute respiratory syndrome virus
KVNSMVHLLTDKLHRLQVQTQP

SEQ ID NO: 364 - protein, 24 aa, Human severe acute respiratory syndrome virus
MFWHGCMLLLSMVIGGFLIDSPLL

SEQ ID NO: 365 - protein, 7 aa, Human severe acute respiratory syndrome virus
MTLTLWQ

SEQ ID NO: 366 - protein, 6 aa, Human severe acute respiratory syndrome virus
STTMNL

SEQ ID NO: 367 - protein, 19 aa, Human severe acute respiratory syndrome virus
HKIMLTYWDLFLLKQELPS

SEQ ID NO: 368 - protein, 5 aa, Human severe acute respiratory syndrome virus
ICVLL

SEQ ID NO: 369 - protein, 7 aa, Human severe acute respiratory syndrome virus
KSCCRMV

SEQ ID NO: 370 - protein, 10 aa, Human severe acute respiratory syndrome virus
MVVLSLVALF

SEQ ID NO: 371 - protein, 34 aa, Human severe acute respiratory syndrome virus
KMSLHHLMLLDNALVLPSKVSSRKLLRALIIGCF

SEQ ID NO: 372 - protein, 67 aa, Human severe acute respiratory syndrome virus
FLFKVHSGHCFSLFTRMLSCHLLLVLWQLLHVLCCLLSISTHSCACFCYLLLQQLLTLIWSTCLLAG

SEQ ID NO: 373 - protein, 24 aa, Human severe acute respiratory syndrome virus
HGLNWLTLACLVIGLRIVLCMLQL

SEQ ID NO: 374 - protein, 5 aa, Human severe acute respiratory syndrome virus
FCLFS

SEQ ID NO: 375 - protein, 15 aa, Human severe acute respiratory syndrome virus
QLALFMMMLLDVFGH

SEQ ID NO: 376 - protein, 14 aa, Human severe acute respiratory syndrome virus
MSLHLFTKSTMVML

SEQ ID NO: 377 - protein, 8 aa, Human severe acute respiratory syndrome virus
IKLFPCGP

SEQ ID NO: 378 - protein, 13 aa, Human severe acute respiratory syndrome virus
PLTILVSLRLSCF

SEQ ID NO: 379 - protein, 27 aa, Human severe acute respiratory syndrome virus
CLCVLSITHCYLLLATPYSVSCLFIVS

SEQ ID NO: 380 - protein, 36 aa, Human severe acute respiratory syndrome virus
AIVAAATLAFSVYSTVTSGLLLVFMTTWSLHKNLGI

SEQ ID NO: 381 - protein, 41 aa, Human severe acute respiratory syndrome virus
TPRGFCLLRVVLMLSSLTLSCWVLEVNHVSRLLLYSLKCLT

SEQ ID NO: 382 - protein, 15 aa, Human severe acute respiratory syndrome virus
SAHLWYCSRFFNNLE

SEQ ID NO: 383 - protein, 43 aa, Human severe acute respiratory syndrome virus
SHLLNCGHNVYNSTMIFFLQKTQLKLSRRWFLFCLFCYPCRVL

SEQ ID NO: 384 - protein, 42 aa, Human severe acute respiratory syndrome virus
TLIGCARKCSITVLLFRLLLQNLVLYHHMPLMPLPRRPMSRL

SEQ ID NO: 385 - protein, 11 aa, Human severe acute respiratory syndrome virus
LMVILKSFSKS

SEQ ID NO: 386 - protein, 24 aa, Human severe acute respiratory syndrome virus
MWLNLSLTVMLPCNASWKRWQIRL

SEQ ID NO: 387 - protein, 15 aa, Human severe acute respiratory syndrome virus
PKCTNRQDLRTRGQK

SEQ ID NO: 388 - protein, 38 aa, Human severe acute respiratory syndrome virus
LVLCKQCSSLCLGSLIMMHLTTLSTMRVMVVFHSTSYH

SEQ ID NO: 389 - protein, 66 aa, Human severe acute respiratory syndrome virus
LQQPNSWLLSLIMVPTRTLVMVTPLHMHLHSGKSSKLLMRIARLFNLVKLTWTIHQIWLGLLLLQL

SEQ ID NO: 390 - protein, 12 aa, Human severe acute respiratory syndrome virus
EPTQLLNYRIMN

SEQ ID NO: 391 - protein, 77 aa, Human severe acute respiratory syndrome virus
HYDRCPVRLVPHKQLVLMTMHLPTITIRREVGLCWHYYQTTKISNGLDSLRVMVQVQFTQNWNHLVGLLQTHQKGLK

SEQ ID NO: 392 - protein, 8 aa, Human severe acute respiratory syndrome virus
NTCTSSKA

SEQ ID NO: 393 - protein, 8 aa, Human severe acute respiratory syndrome virus
IEVWCWAV

SEQ ID NO: 394 - protein, 27 aa, Human severe acute respiratory syndrome virus
LLQYVFRLEMLQKYLPIQLCFPSVLLQ

SEQ ID NO: 395 - protein, 9 aa, Human severe acute respiratory syndrome virus
TLLKHIRIT

SEQ ID NO: 396 - protein, 10 aa, Human severe acute respiratory syndrome virus
QVEDNQSPTV

SEQ ID NO: 397 - protein, 14 aa, Human severe acute respiratory syndrome virus
RCCVHTLVQDRQLL

SEQ ID NO: 398 - protein, 34 aa, Human severe acute respiratory syndrome virus
HQKLTWTKSPLVVLHVVCIVDATLTIQILKDSVT

SEQ ID NO: 399 - protein, 44 aa, Human severe acute respiratory syndrome virus
KVSTSKYLPLVLMTQWVLHLETQSVPSAECGKVMAVVVTNSANP

SEQ ID NO: 400 - protein, 9 aa, Human severe acute respiratory syndrome virus
CSLRMHQRF

SEQ ID NO: 401 - protein, 17 aa, Human severe acute respiratory syndrome virus
TGLRCKCSPSYTVRHRH

SEQ ID NO: 402 - protein, 6 aa, Human severe acute respiratory syndrome virus
CRLQGF

SEQ ID NO: 403 - protein, 15 aa, Human severe acute respiratory syndrome virus
YLQRKKCWFCKVPKN

SEQ ID NO: 404 - protein, 8 aa, Human severe acute respiratory syndrome virus
LLSLPGEG

SEQ ID NO: 405 - protein, 11 aa, Human severe acute respiratory syndrome virus
GRQFIRLLLCS

SEQ ID NO: 406 - protein, 5 aa, Human severe acute respiratory syndrome virus
EAYYV

SEQ ID NO: 407 - protein, 4 aa, Human severe acute respiratory syndrome virus
RDYL

SEQ ID NO: 408 - protein, 8 aa, Human severe acute respiratory syndrome virus
RLSSGCCP

SEQ ID NO: 409 - protein, 4 aa, Human severe acute respiratory syndrome virus
LFQV

SEQ ID NO: 410 - protein, 11 aa, Human severe acute respiratory syndrome virus
HGTTYITSASN

SEQ ID NO: 411 - protein, 4 aa, Human severe acute respiratory syndrome virus
IHNG

SEQ ID NO: 412 - protein, 8 aa, Human severe acute respiratory syndrome virus
FSLCSTSF

SEQ ID NO: 413 - protein, 12 aa, Human severe acute respiratory syndrome virus
YIKRNTRHIQLL

SEQ ID NO: 414 - protein, 4 aa, Human severe acute respiratory syndrome virus
EGLV

SEQ ID NO: 415 - protein, 5 aa, Human severe acute respiratory syndrome virus
LRRES

SEQ ID NO: 416 - protein, 6 aa, Human severe acute respiratory syndrome virus
HLTRIC

SEQ ID NO: 417 - protein, 17 aa, Human severe acute respiratory syndrome virus
ACTPIIIKDCTILRCYA

SEQ ID NO: 418 - protein, 10 aa, Human severe acute respiratory syndrome virus
CRHCRRTDIR

SEQ ID NO: 419 - protein, 7 aa, Human severe acute respiratory syndrome virus
WELVRFR

SEQ ID NO: 420 - protein, 27 aa, Human severe acute respiratory syndrome virus
FRTSSTRLRSSYCGFILLIADAHPHFD

SEQ ID NO: 421 - protein, 4 aa, Human severe acute respiratory syndrome virus
GIGC

SEQ ID NO: 422 - protein, 5 aa, Human severe acute respiratory syndrome virus
VPYGC

SEQ ID NO: 423 - protein, 6 aa, Human severe acute respiratory syndrome virus
SRKTTY

SEQ ID NO: 424 - protein, 6 aa, Human severe acute respiratory syndrome virus
VGFAEI

SEQ ID NO: 425 - protein, 13 aa, Human severe acute respiratory syndrome virus
FYGRETLSLRPLF

SEQ ID NO: 426 - protein, 11 aa, Human severe acute respiratory syndrome virus
ILGPDIPSQLY

SEQ ID NO: 427 - protein, 8 aa, Human severe acute respiratory syndrome virus
VYPSLCKL

SEQ ID NO: 428 - protein, 35 aa, Human severe acute respiratory syndrome virus
CVIFYCVSTYKFWTTSKKNICRWCSFCCFNWIPFS

SEQ ID NO: 429 - protein, 5 aa, Human severe acute respiratory syndrome virus
VRSRT

SEQ ID NO: 430 - protein, 6 aa, Human severe acute respiratory syndrome virus
SGCKLT

SEQ ID NO: 431 - protein, 13 aa, Human severe acute respiratory syndrome virus
LASQFQGTFSVCC

SEQ ID NO: 432 - protein, 13 aa, Human severe acute respiratory syndrome virus
SSYACSFWQFIAR

SEQ ID NO: 433 - protein, 22 aa, Human severe acute respiratory syndrome virus
THYMLFSSCTNKQCCFSNCQTR

SEQ ID NO: 434 - protein, 4 aa, Human severe acute respiratory syndrome virus
LCCV

SEQ ID NO: 435 - protein, 5 aa, Human severe acute respiratory syndrome virus
GRKFC

SEQ ID NO: 436 - protein, 15 aa, Human severe acute respiratory syndrome virus
TKTLLLCSGWQRCYQ

SEQ ID NO: 437 - protein, 4 aa, Human severe acute respiratory syndrome virus
LLSL

SEQ ID NO: 438 - protein, 5 aa, Human severe acute respiratory syndrome virus
SANNV

SEQ ID NO: 439 - protein, 8 aa, Human severe acute respiratory syndrome virus
YQTTPIRS

SEQ ID NO: 440 - protein, 7 aa, Human severe acute respiratory syndrome virus
LLRWWLY

SEQ ID NO: 441 - protein, 6 aa, Human severe acute respiratory syndrome virus
CQPSNR

SEQ ID NO: 442 - protein, 6 aa, Human severe acute respiratory syndrome virus
ISWFPI

SEQ ID NO: 443 - protein, 4 aa, Human severe acute respiratory syndrome virus
LNEL

SEQ ID NO: 444 - protein, 9 aa, Human severe acute respiratory syndrome virus
GSRCTFRVY

SEQ ID NO: 445 - protein, 10 aa, Human severe acute respiratory syndrome virus
CHPYYNSNES

SEQ ID NO: 446 - protein, 10 aa, Human severe acute respiratory syndrome virus
SSHRSWCLYL

SEQ ID NO: 447 - protein, 4 aa, Human severe acute respiratory syndrome virus
YYDK

SEQ ID NO: 448 - protein, 13 aa, Human severe acute respiratory syndrome virus
TVSSEIIEVNSRH

SEQ ID NO: 449 - protein, 16 aa, Human severe acute respiratory syndrome virus
RSYCGNWNKQVLRWLA

SEQ ID NO: 450 - protein, 7 aa, Human severe acute respiratory syndrome virus
YVKNCLQ

SEQ ID NO: 451 - protein, 14 aa, Human severe acute respiratory syndrome virus
CRNSTPYGLGLSKM

SEQ ID NO: 452 - protein, 4 aa, Human severe acute respiratory syndrome virus
QSHA

SEQ ID NO: 453 - protein, 11 aa, Human severe acute respiratory syndrome virus
DNGLSCSCSQT

SEQ ID NO: 454 - protein, 9 aa, Human severe acute respiratory syndrome virus
LITPFLQVS

SEQ ID NO: 455 - protein, 7 aa, Human severe acute respiratory syndrome virus
RVCASIK

SEQ ID NO: 456 - protein, 10 aa, Human severe acute respiratory syndrome virus
DGHVWRLTIC

SEQ ID NO: 457 - protein, 7 aa, Human severe acute respiratory syndrome virus
TRWNIIR

SEQ ID NO: 458 - protein, 6 aa, Human severe acute respiratory syndrome virus
CYNCLC

SEQ ID NO: 459 - protein, 15 aa, Human severe acute respiratory syndrome virus
HLSSCYSQCKCTSFN

SEQ ID NO: 460 - protein, 11 aa, Human severe acute respiratory syndrome virus
QVCPQSTTQAL

SEQ ID NO: 461 - protein, 6 aa, Human severe acute respiratory syndrome virus
VLRLPA

SEQ ID NO: 462 - protein, 8 aa, Human severe acute respiratory syndrome virus
TFLHDDSF

SEQ ID NO: 463 - protein, 5 aa, Human severe acute respiratory syndrome virus
CRCVL

SEQ ID NO: 464 - protein, 8 aa, Human severe acute respiratory syndrome virus
LCGSRFSS

SEQ ID NO: 465 - protein, 7 aa, Human severe acute respiratory syndrome virus
GSSLLSK

SEQ ID NO: 466 - protein, 4 aa, Human severe acute respiratory syndrome virus
CVHV

SEQ ID NO: 467 - protein, 5 aa, Human severe acute respiratory syndrome virus
GKMLD

SEQ ID NO: 468 - protein, 13 aa, Human severe acute respiratory syndrome virus
RTSRILLTAYNAS

SEQ ID NO: 469 - protein, 20 aa, Human severe acute respiratory syndrome virus
LRVPALPRSIKNIRRRLFCR

SEQ ID NO: 470 - protein, 10 aa, Human severe acute respiratory syndrome virus
YCQNRWYTYD

SEQ ID NO: 471 - protein, 7 aa, Human severe acute respiratory syndrome virus
KVRVTGY

SEQ ID NO: 472 - protein, 8 aa, Human severe acute respiratory syndrome virus
CLPTYKTS

SEQ ID NO: 473 - protein, 4 aa, Human severe acute respiratory syndrome virus
SGVC

SEQ ID NO: 474 - protein, 9 aa, Human severe acute respiratory syndrome virus
CLSLVFTIH

SEQ ID NO: 475 - protein, 14 aa, Human severe acute respiratory syndrome virus
AYWPHVGHVFRNAN

SEQ ID NO: 476 - protein, 7 aa, Human severe acute respiratory syndrome virus
HLTVLGT

SEQ ID NO: 477 - protein, 30 aa, Human severe acute respiratory syndrome virus
GYVHTTYSLAGCRCLCIVQFTDFTSLRCLY

SEQ ID NO: 478 - protein, 10 aa, Human severe acute respiratory syndrome virus
ETIPMLQVLL

SEQ ID NO: 479 - protein, 13 aa, Human severe acute respiratory syndrome virus
PCHFNITQISVVC

SEQ ID NO: 480 - protein, 9 aa, Human severe acute respiratory syndrome virus
SLCLQCPRL

SEQ ID NO: 481 - protein, 16 aa, Human severe acute respiratory syndrome virus
CDTTVSRRYELLLQVT

SEQ ID NO: 482 - protein, 5 aa, Human severe acute respiratory syndrome virus
FSIMC

SEQ ID NO: 483 - protein, 14 aa, Human severe acute respiratory syndrome virus
WSGFWFIQKHMCRQ

SEQ ID NO: 484 - protein, 7 aa, Human severe acute respiratory syndrome virus
LQCDSNM

SEQ ID NO: 485 - protein, 11 aa, Human severe acute respiratory syndrome virus
CWRLHTCQHLY

SEQ ID NO: 486 - protein, 13 aa, Human severe acute respiratory syndrome virus
ETQAFRSRNAQSH

SEQ ID NO: 487 - protein, 13 aa, Human severe acute respiratory syndrome virus
AVIWYCHCTRSTL

SEQ ID NO: 488 - protein, 12 aa, Human severe acute respiratory syndrome virus
QRIASFMGGWKT

SEQ ID NO: 489 - protein, 15 aa, Human severe acute respiratory syndrome virus
TTIEQKLCLYWLPCN

SEQ ID NO: 490 - protein, 8 aa, Human severe acute respiratory syndrome virus
STDWRVHL

SEQ ID NO: 491 - protein, 15 aa, Human severe acute respiratory syndrome virus
CCCVQRYYDIQVECW

SEQ ID NO: 492 - protein, 12 aa, Human severe acute respiratory syndrome virus
LLCVDISHCNAT

SEQ ID NO: 493 - protein, 24 aa, Human severe acute respiratory syndrome virus
CTYSSATRALCENYWLVPNTQHLR

SEQ ID NO: 494 - protein, 23 aa, Human severe acute respiratory syndrome virus
QCCKLSKGRHAKVLYTPRTTWYW

SEQ ID NO: 495 - protein, 26 aa, Human severe acute respiratory syndrome virus
ESFCHRTCSLLPICSHSVYGMLSCSC

SEQ ID NO: 496 - protein, 9 aa, Human severe acute respiratory syndrome virus
KGIKIFAHR

SEQ ID NO: 497 - protein, 11 aa, Human severe acute respiratory syndrome virus
NHTCACARRVF

SEQ ID NO: 498 - protein, 23 aa, Human severe acute respiratory syndrome virus
IQSEFNTRTVCFLHCKCIARNNC

SEQ ID NO: 499 - protein, 4 aa, Human severe acute respiratory syndrome virus
HCSL

SEQ ID NO: 500 - protein, 5 aa, Human severe acute respiratory syndrome virus
NLYGY

SEQ ID NO: 501 - protein, 6 aa, Human severe acute respiratory syndrome virus
LECCQC

SEQ ID NO: 502 - protein, 23 aa, Human severe acute respiratory syndrome virus
TSCKTLRLYWRSCSITSPPHIAD

SEQ ID NO: 503 - protein, 8 aa, Human severe acute respiratory syndrome virus
RHTRTRIF

SEQ ID NO: 504 - protein, 23 aa, Human severe acute respiratory syndrome virus
FSVQTYENNRSRHVPWNLSPLSC

SEQ ID NO: 505 - protein, 7 aa, Human severe acute respiratory syndrome virus
HCECFSL

SEQ ID NO: 506 - protein, 6 aa, Human severe acute respiratory syndrome virus
AKSTQG

SEQ ID NO: 507 - protein, 15 aa, Human severe acute respiratory syndrome virus
VSSMLQNVLQRCYYT

SEQ ID NO: 508 - protein, 32 aa, Human severe acute respiratory syndrome virus
CFICNQQTSNRRCKRISYTQSCLEKSCFYLTL

SEQ ID NO: 509 - protein, 17 aa, Human severe acute respiratory syndrome virus
FTERCSFKNLRIAYADC

SEQ ID NO: 510 - protein, 5 aa, Human severe acute respiratory syndrome virus
FITGF

SEQ ID NO: 511 - protein, 8 aa, Human severe acute respiratory syndrome virus
LCHIHTNY

SEQ ID NO: 512 - protein, 5 aa, Human severe acute respiratory syndrome virus
NSTLL

SEQ ID NO: 513 - protein, 20 aa, Human severe acute respiratory syndrome virus
CQPLQCGYHKGKNWHFVHNV

SEQ ID NO: 514 - protein, 26 aa, Human severe acute respiratory syndrome virus
QTAIYKSRNTTSQCGYITSRKCNWTF

SEQ ID NO: 515 - protein, 16 aa, Human severe acute respiratory syndrome virus
DHYWSSSYTGTYTPQR

SEQ ID NO: 516 - protein, 5 aa, Human severe acute respiratory syndrome virus
YKIQD

SEQ ID NO: 517 - protein, 4 aa, Human severe acute respiratory syndrome virus
RIMC

SEQ ID NO: 518 - protein, 11 aa, Human severe acute respiratory syndrome virus
HTRHTKGHDLP

SEQ ID NO: 519 - protein, 17 aa, Human severe acute respiratory syndrome virus
THLYDGFQNELPSQWLP

SEQ ID NO: 520 - protein, 18 aa, Human severe acute respiratory syndrome virus
YVYHPRRSYSSRSCVDWL

SEQ ID NO: 521 - protein, 7 aa, Human severe acute respiratory syndrome virus
CRGLSCN

SEQ ID NO: 522 - protein, 5 aa, Human severe acute respiratory syndrome virus
RCCGY

SEQ ID NO: 523 - protein, 11 aa, Human severe acute respiratory syndrome virus
PTSPARIFYRC

SEQ ID NO: 524 - protein, 9 aa, Human severe acute respiratory syndrome virus
LSSCTDWLC

SEQ ID NO: 525 - protein, 6 aa, Human severe acute respiratory syndrome virus
HRIHQS

SEQ ID NO: 526 - protein, 6 aa, Human severe acute respiratory syndrome virus
CKTSTR

SEQ ID NO: 527 - protein, 7 aa, Human severe acute respiratory syndrome virus
TSYTTHV

SEQ ID NO: 528 - protein, 9 aa, Human severe acute respiratory syndrome virus
RLALECSAY

SEQ ID NO: 529 - protein, 6 aa, Human severe acute respiratory syndrome virus
DSTNAQ

SEQ ID NO: 530 - protein, 18 aa, Human severe acute respiratory syndrome virus
YTERIVRQSRVRPLGAWL

SEQ ID NO: 531 - protein, 12 aa, Human severe acute respiratory syndrome virus
AYINEVLCQDWT

SEQ ID NO: 532 - protein, 6 aa, Human severe acute respiratory syndrome virus
KNVLSV

SEQ ID NO: 533 - protein, 22 aa, Human severe acute respiratory syndrome virus
QTCNLLFYFIRYLCLLESFCGF

SEQ ID NO: 534 - protein, 4 aa, Human severe acute respiratory syndrome virus
PIYD

SEQ ID NO: 535 - protein, 8 aa, Human severe acute respiratory syndrome virus
CSAVGLYG

SEQ ID NO: 536 - protein, 12 aa, Human severe acute respiratory syndrome virus
PTLPGTWKCTCG

SEQ ID NO: 537 - protein, 4 aa, Human severe acute respiratory syndrome virus
CYHD

SEQ ID NO: 538 - protein, 5 aa, Human severe acute respiratory syndrome virus
MFSSP

SEQ ID NO: 539 - protein, 6 aa, Human severe acute respiratory syndrome virus
IPYYRR

SEQ ID NO: 540 - protein, 17 aa, Human severe acute respiratory syndrome virus
FCLQKSTTHGCEVCIAC

SEQ ID NO: 541 - protein, 5 aa, Human severe acute respiratory syndrome virus
VSSSS

SEQ ID NO: 542 - protein, 13 aa, Human severe acute respiratory syndrome virus
HWKSKGYQVCASG

SEQ ID NO: 543 - protein, 11 aa, Human severe acute respiratory syndrome virus
SRMEVLRCSAM

SEQ ID NO: 544 - protein, 17 aa, Human severe acute respiratory syndrome virus
QSLQNRGTLLFLCYTSR

SEQ ID NO: 545 - protein, 8 aa, Human severe acute respiratory syndrome virus
WCLFVLEL

SEQ ID NO: 546 - protein, 9 aa, Human severe acute respiratory syndrome virus
SLPSQCNCV

SEQ ID NO: 547 - protein, 12 aa, Human severe acute respiratory syndrome virus
HKSLVKLELTRL

SEQ ID NO: 548 - protein, 4 aa, Human severe acute respiratory syndrome virus
FVCE

SEQ ID NO: 549 - protein, 9 aa, Human severe acute respiratory syndrome virus
ACIPHSSFR

SEQ ID NO: 550 - protein, 4 aa, Human severe acute respiratory syndrome virus
KCIY

SEQ ID NO: 551 - protein, 10 aa, Human severe acute respiratory syndrome virus
FKAIAFLLLF

SEQ ID NO: 552 - protein, 10 aa, Human severe acute respiratory syndrome virus
VSWQTSSVGY

SEQ ID NO: 553 - protein, 25 aa, Human severe acute respiratory syndrome virus
LCSTQICYVYYTMQFRWCCLQTPCK

SEQ ID NO: 554 - protein, 8 aa, Human severe acute respiratory syndrome virus
VPTVLGCI

SEQ ID NO: 555 - protein, 7 aa, Human severe acute respiratory syndrome virus
YDDFCWI

SEQ ID NO: 556 - protein, 7 aa, Human severe acute respiratory syndrome virus
PMDLQTI

SEQ ID NO: 557 - protein, 16 aa, Human severe acute respiratory syndrome virus
PVEYIYQVTEFRKCGL

SEQ ID NO: 558 - protein, 11 aa, Human severe acute respiratory syndrome virus
WTRRRSTCFHH

SEQ ID NO: 559 - protein, 9 aa, Human severe acute respiratory syndrome virus
CCLHKGRWY

SEQ ID NO: 560 - protein, 4 aa, Human severe acute respiratory syndrome virus
CGDL

SEQ ID NO: 561 - protein, 5 aa, Human severe acute respiratory syndrome virus
DNTSC

SEQ ID NO: 562 - protein, 5 aa, Human severe acute respiratory syndrome virus
TSARD

SEQ ID NO: 563 - protein, 23 aa, Human severe acute respiratory syndrome virus
YCNLGLQKRSPSTCIYNRCLHND

SEQ ID NO: 564 - protein, 6 aa, Human severe acute respiratory syndrome virus
HCQETY

SEQ ID NO: 565 - protein, 10 aa, Human severe acute respiratory syndrome virus
ECLFFTYCLV

SEQ ID NO: 566 - protein, 8 aa, Human severe acute respiratory syndrome virus
SGRTGRPF

SEQ ID NO: 567 - protein, 21 aa, Human severe acute respiratory syndrome virus
WCFNNRRFSQRSNTFKGTSTS

SEQ ID NO: 568 - protein, 15 aa, Human severe acute respiratory syndrome virus
RQWSHINWRISKNTV

SEQ ID NO: 569 - protein, 10 aa, Human severe acute respiratory syndrome virus
ESRRHYSTVA

SEQ ID NO: 570 - protein, 12 aa, Human severe acute respiratory syndrome virus
NLLYSEQRLRGF

SEQ ID NO: 571 - protein, 7 aa, Human severe acute respiratory syndrome virus
AQITNGN

SEQ ID NO: 572 - protein, 7 aa, Human severe acute respiratory syndrome virus
LSRARYG

SEQ ID NO: 573 - protein, 5 aa, Human severe acute respiratory syndrome virus
IHTAI

SEQ ID NO: 574 - protein, 37 aa, Human severe acute respiratory syndrome virus
ARGLCLRTHRLWRFQSWTTWRSSFNDRLSQALTRFTT

SEQ ID NO: 575 - protein, 31 aa, Human severe acute respiratory syndrome virus
IRGFYPYGQHSEKLLHNRCANRFIKMCVFCD

SEQ ID NO: 576 - protein, 21 aa, Human severe acute respiratory syndrome virus
LCRDNKVTRFVSDFKSGQGYN

SEQ ID NO: 577 - protein, 7 aa, Human severe acute respiratory syndrome virus
NFIHALV

SEQ ID NO: 578 - protein, 4 aa, Human severe acute respiratory syndrome virus
GWTC

SEQ ID NO: 579 - protein, 19 aa, Human severe acute respiratory syndrome virus
NLLPKTTSKSSVATRCCDA

SEQ ID NO: 580 - protein, 9 aa, Human severe acute respiratory syndrome virus
LVQDAKNAS

SEQ ID NO: 581 - protein, 5 aa, Human severe acute respiratory syndrome virus
PSELW

SEQ ID NO: 582 - protein, 42 aa, Human severe acute respiratory syndrome virus
KCCYTKRNNDECRKVYSTVSILKYTYFSCTLQHESYSLWCWL

SEQ ID NO: 583 - protein, 24 aa, Human severe acute respiratory syndrome virus
RSCTRYSCAQTMVANWHTTCRFRS

SEQ ID NO: 584 - protein, 19 aa, Human severe acute respiratory syndrome virus
LRLRRRFYFNWRLCNSTYG

SEQ ID NO: 585 - protein, 5 aa, Human severe acute respiratory syndrome virus
MGPYY

SEQ ID NO: 586 - protein, 8 aa, Human severe acute respiratory syndrome virus
DQTCDKRE

SEQ ID NO: 587 - protein, 32 aa, Human severe acute respiratory syndrome virus
RRVFHLSVWIYKAKTSPGWFYSCKDNRAFLEC

SEQ ID NO: 588 - protein, 30 aa, Human severe acute respiratory syndrome virus
PLQAYGPFLMVDSFCYKCKCIIIGSIFNWG

SEQ ID NO: 589 - protein, 9 aa, Human severe acute respiratory syndrome virus
LSWQAEGTN

SEQ ID NO: 590 - protein, 6 aa, Human severe acute respiratory syndrome virus
WLYHAC

SEQ ID NO: 591 - protein, 18 aa, Human severe acute respiratory syndrome virus
LHFLEEHKSYPVVFLFTL

SEQ ID NO: 592 - protein, 6 aa, Human severe acute respiratory syndrome virus
HEQISS

SEQ ID NO: 593 - protein, 9 aa, Human severe acute respiratory syndrome virus
IKRNCCNVS

SEQ ID NO: 594 - protein, 5 aa, Human severe acute respiratory syndrome virus
GESNQ

SEQ ID NO: 595 - protein, 9 aa, Human severe acute respiratory syndrome virus
YDLFSSGKR

SEQ ID NO: 596 - protein, 9 aa, Human severe acute respiratory syndrome virus
RKQQSCGFK

SEQ ID NO: 597 - protein, 15 aa, Human severe acute respiratory syndrome virus
QLNEHVYFLIISYSH

SEQ ID NO: 598 - protein, 5 aa, Human severe acute respiratory syndrome virus
PVHHF

SEQ ID NO: 599 - protein, 4 aa, Human severe acute respiratory syndrome virus
CSSS

SEQ ID NO: 600 - protein, 14 aa, Human severe acute respiratory syndrome virus
LHSTYFIYEGGLLS

SEQ ID NO: 601 - protein, 16 aa, Human severe acute respiratory syndrome virus
IRHSLFNSGFISSILF

SEQ ID NO: 602 - protein, 7 aa, Human severe acute respiratory syndrome virus
CYRVSYY

SEQ ID NO: 603 - protein, 10 aa, Human severe acute respiratory syndrome virus
SYVWQPCHTF

SEQ ID NO: 604 - protein, 33 aa, Human severe acute respiratory syndrome virus
GWYLFCCHREIKCCPWLGFWFYHEQQVTVGDYY

SEQ ID NO: 605 - protein, 6 aa, Human severe acute respiratory syndrome virus
CCYTSM

SEQ ID NO: 606 - protein, 7 aa, Human severe acute respiratory syndrome virus
QPFLCCF

SEQ ID NO: 607 - protein, 12 aa, Human severe acute respiratory syndrome virus
THGYTDTYYDIR

SEQ ID NO: 608 - protein, 7 aa, Human severe acute respiratory syndrome virus
LHFRVHI

SEQ ID NO: 609 - protein, 4 aa, Human severe acute respiratory syndrome virus
CLFA

SEQ ID NO: 610 - protein, 6 aa, Human severe acute respiratory syndrome virus
CFRKVR

SEQ ID NO: 611 - protein, 7 aa, Human severe acute respiratory syndrome virus
TLTRVCV

SEQ ID NO: 612 - protein, 7 aa, Human severe acute respiratory syndrome virus
RWVSLCL

SEQ ID NO: 613 - protein, 9 aa, Human severe acute respiratory syndrome virus
GLSTYRCSS

SEQ ID NO: 614 - protein, 5 aa, Human severe acute respiratory syndrome virus
STFWF

SEQ ID NO: 615 - protein, 6 aa, Human severe acute respiratory syndrome virus
HFETYF

SEQ ID NO: 616 - protein, 5 aa, Human severe acute respiratory syndrome virus
VASWY

SEQ ID NO: 617 - protein, 4 aa, Human severe acute respiratory syndrome virus
HYKF

SEQ ID NO: 618 - protein, 34 aa, Human severe acute respiratory syndrome virus
SHSYSLFTCSRHLGHVSCSLFCWLFKANYIYAQV

SEQ ID NO: 619 - protein, 8 aa, Human severe acute respiratory syndrome virus
KWYNHRCC

SEQ ID NO: 620 - protein, 7 aa, Human severe acute respiratory syndrome virus
LFSKSTC

SEQ ID NO: 621 - protein, 5 aa, Human severe acute respiratory syndrome virus
TQMLC

SEQ ID NO: 622 - protein, 7 aa, Human severe acute respiratory syndrome virus
QRNLPDL

SEQ ID NO: 623 - protein, 13 aa, Human severe acute respiratory syndrome virus
FQGCSLRRCCEIP

SEQ ID NO: 624 - protein, 11 aa, Human severe acute respiratory syndrome virus
YYKLVSFWRGF

SEQ ID NO: 625 - protein, 13 aa, Human severe acute respiratory syndrome virus
IPFCLCMGEKKNF

SEQ ID NO: 626 - protein, 13 aa, Human severe acute respiratory syndrome virus
LLCALQLNIFFNL

SEQ ID NO: 627 - protein, 7 aa, Human severe acute respiratory syndrome virus
VLWRFCH

SEQ ID NO: 628 - protein, 16 aa, Human severe acute respiratory syndrome virus
SLLLQCLCRFFCSQGR

SEQ ID NO: 629 - protein, 13 aa, Human severe acute respiratory syndrome virus
CKTNSARTNWCYC

SEQ ID NO: 630 - protein, 10 aa, Human severe acute respiratory syndrome virus
FHGLCPCLEY

SEQ ID NO: 631 - protein, 5 aa, Human severe acute respiratory syndrome virus
CYFNW

SEQ ID NO: 632 - protein, 4 aa, Human severe acute respiratory syndrome virus
TWQA

SEQ ID NO: 633 - protein, 4 aa, Human severe acute respiratory syndrome virus
ERHI

SEQ ID NO: 634 - protein, 5 aa, Human severe acute respiratory syndrome virus
CAFLP

SEQ ID NO: 635 - protein, 9 aa, Human severe acute respiratory syndrome virus
WQTLHPTCS

SEQ ID NO: 636 - protein, 6 aa, Human severe acute respiratory syndrome virus
LLLAIK

SEQ ID NO: 637 - protein, 21 aa, Human severe acute respiratory syndrome virus
LWFLHHYWHWLPTLQSCSTFF

SEQ ID NO: 638 - protein, 15 aa, Human severe acute respiratory syndrome virus
TFKCTGHGLWTKIIH

SEQ ID NO: 639 - protein, 6 aa, Human severe acute respiratory syndrome virus
EPVCQF

SEQ ID NO: 640 - protein, 23 aa, Human severe acute respiratory syndrome virus
WTHWYWCVNSFFKEISTISTIWP

SEQ ID NO: 641 - protein, 5 aa, Human severe acute respiratory syndrome virus
FRSRS

SEQ ID NO: 642 - protein, 23 aa, Human severe acute respiratory syndrome virus
NIRHFTLLFWGCKCNYTWNKCFI

SEQ ID NO: 643 - protein, 8 aa, Human severe acute respiratory syndrome virus
SCCSISRC

SEQ ID NO: 644 - protein, 34 aa, Human severe acute respiratory syndrome virus
CFYSNSCRSTHTSLAHIFYWKQCIPDSSRLSYRS

SEQ ID NO: 645 - protein, 6 aa, Human severe acute respiratory syndrome virus
ACRHFL

SEQ ID NO: 646 - protein, 11 aa, Human severe acute respiratory syndrome virus
VRHSYWSWHLC

SEQ ID NO: 647 - protein, 8 aa, Human severe acute respiratory syndrome virus
LPYSFFIT

SEQ ID NO: 648 - protein, 13 aa, Human severe acute respiratory syndrome virus
PKIYCGLYYVFRC

SEQ ID NO: 649 - protein, 5 aa, Human severe acute respiratory syndrome virus
FNCLL

SEQ ID NO: 650 - protein, 6 aa, Human severe acute respiratory syndrome virus
HHCYTY

SEQ ID NO: 651 - protein, 11 aa, Human severe acute respiratory syndrome virus
HYYRSNACFYG

SEQ ID NO: 652 - protein, 5 aa, Human severe acute respiratory syndrome virus
NLRRL

SEQ ID NO: 653 - protein, 8 aa, Human severe acute respiratory syndrome virus
YVHLRRFY

SEQ ID NO: 654 - protein, 6 aa, Human severe acute respiratory syndrome virus
FASPIW

SEQ ID NO: 655 - protein, 14 aa, Human severe acute respiratory syndrome virus
LLHTTKSCTLRYCC

SEQ ID NO: 656 - protein, 6 aa, Human severe acute respiratory syndrome virus
TGSQHT

SEQ ID NO: 657 - protein, 20 aa, Human severe acute respiratory syndrome virus
SVRSSQTNVQNPNFEIFWWF

SEQ ID NO: 658 - protein, 6 aa, Human severe acute respiratory syndrome virus
FFTNIT

SEQ ID NO: 659 - protein, 5 aa, Human severe acute respiratory syndrome virus
PSKAN

SEQ ID NO: 660 - protein, 4 aa, Human severe acute respiratory syndrome virus
EVFY

SEQ ID NO: 661 - protein, 4 aa, Human severe acute respiratory syndrome virus
GLAL

SEQ ID NO: 662 - protein, 4 aa, Human severe acute respiratory syndrome virus
GDTR

SEQ ID NO: 663 - protein, 12 aa, Human severe acute respiratory syndrome virus
CWLHEAIWRMPR

SEQ ID NO: 664 - protein, 19 aa, Human severe acute respiratory syndrome virus
RSHLCAEVQWTYSVATSAH

SEQ ID NO: 665 - protein, 10 aa, Human severe acute respiratory syndrome virus
YDCCLHCCSS

SEQ ID NO: 666 - protein, 25 aa, Human severe acute respiratory syndrome virus
WYCHCWMDIWCWRCSSNTFCYANGI

SEQ ID NO: 667 - protein, 12 aa, Human severe acute respiratory syndrome virus
VQWHWSYPKCSL

SEQ ID NO: 668 - protein, 9 aa, Human severe acute respiratory syndrome virus
EPKTNRQPI

SEQ ID NO: 669 - protein, 20 aa, Human severe acute respiratory syndrome virus
SNSRITYNNINCIGQAARRC

SEQ ID NO: 670 - protein, 10 aa, Human severe acute respiratory syndrome virus
PECSSIKHTC

SEQ ID NO: 671 - protein, 9 aa, Human severe acute respiratory syndrome virus
FWCNFKCAK

SEQ ID NO: 672 - protein, 5 aa, Human severe acute respiratory syndrome virus
YPFAT

SEQ ID NO: 673 - protein, 7 aa, Human severe acute respiratory syndrome virus
SRGGGTN

SEQ ID NO: 674 - protein, 22 aa, Human severe acute respiratory syndrome virus
QVNYRQTSKPSNLCNTTTNQGC

SEQ ID NO: 675 - protein, 5 aa, Human severe acute respiratory syndrome virus
NQGFC

SEQ ID NO: 676 - protein, 4 aa, Human severe acute respiratory syndrome virus
SCCY

SEQ ID NO: 677 - protein, 9 aa, Human severe acute respiratory syndrome virus
VCSWTIKKS

SEQ ID NO: 678 - protein, 42 aa, Human severe acute respiratory syndrome virus
LLWKGLPPYVLPTSSPAWCCLPTCHVCAIPGEELHHSASNLS

SEQ ID NO: 679 - protein, 7 aa, Human severe acute respiratory syndrome virus
RQSILPS

SEQ ID NO: 680 - protein, 5 aa, Human severe acute respiratory syndrome virus
RCFCV

SEQ ID NO: 681 - protein, 28 aa, Human severe acute respiratory syndrome virus
WHFLVYYTEELLFSTNNYYRQYICLRKL

SEQ ID NO: 682 - protein, 6 aa, Human severe acute respiratory syndrome virus
CRYWHH

SEQ ID NO: 683 - protein, 4 aa, Human severe acute respiratory syndrome virus
QHSL

SEQ ID NO: 684 - protein, 4 aa, Human severe acute respiratory syndrome virus
SSAT

SEQ ID NO: 685 - protein, 18 aa, Human severe acute respiratory syndrome virus
LIQRRAGQVLQKSYITRC

SEQ ID NO: 686 - protein, 7 aa, Human severe acute respiratory syndrome virus
SWRHFRH

SEQ ID NO: 687 - protein, 10 aa, Human severe acute respiratory syndrome virus
RFCRQHSKRN

SEQ ID NO: 688 - protein, 7 aa, Human severe acute respiratory syndrome virus
PSRIGKI

SEQ ID NO: 689 - protein, 27 aa, Human severe acute respiratory syndrome virus
MALVCLARLHCWTNCHRHGYNLALLHD

SEQ ID NO: 690 - protein, 17 aa, Human severe acute respiratory syndrome virus
LLQLPQGCMLLWFLLQV

SEQ ID NO: 691 - protein, 289 aa, Human severe acute respiratory syndrome virus
ASSQGCQITLHINELMDLFMRFFTLGSITAQPVKIDNASPASTVHATATIPLQASLPFGWLVIGVAFLAVFQSATKIIALNKRWQLALYKGFQFICNLLLLFVTIYSHLLLVAAGKEAQFLYLYALIYFLQCINACRIIMRCWLCWKCKSKNPLLYDANYFVCWHTHNYDYCIPYNSVTDTIVVTEGDGISTPKLKEDYQIGGYSEDRHSGVKDYVVVHGYFTEVYYQLESTQITTDTGIENATFFIFNKLVKDPPNVQIHTIDGSSGVANPAMDPIYDEPTTTTSVPL

SEQ ID NO: 692 - protein, 84 aa, Human severe acute respiratory syndrome virus
AQESEYELMYSFVSEETGTLIVNSVLLFLAFVVFLLVTLAILTALRLCAYCCNIVNVSLVKPTVYVYSRVKNLNSSEGVPDLLV

SEQ ID NO: 693 - protein, 9 aa, Human severe acute respiratory syndrome virus
LLLLFCLEL

SEQ ID NO: 694 - protein, 24 aa, Human severe acute respiratory syndrome virus
HCLSWQTTVLLPLRSLNNSWNNGT

SEQ ID NO: 695 - protein, 4 aa, Human severe acute respiratory syndrome virus
VSYS

SEQ ID NO: 696 - protein, 18 aa, Human severe acute respiratory syndrome virus
PGLCYYNLPILIGTGFCT

SEQ ID NO: 697 - protein, 10 aa, Human severe acute respiratory syndrome virus
SLFSSGSCGQ

SEQ ID NO: 698 - protein, 15 aa, Human severe acute respiratory syndrome virus
HLLVLCLLLSTELIG

SEQ ID NO: 699 - protein, 11 aa, Human severe acute respiratory syndrome virus
LAGLRLQWLVL

SEQ ID NO: 700 - protein, 38 aa, Human severe acute respiratory syndrome virus
CGLATSLLPSGCLLVPAQCGHSTQKQTFFSMCLSGGQL

SEQ ID NO: 701 - protein, 13 aa, Human severe acute respiratory syndrome virus
PDRSWKVNLSLVL

SEQ ID NO: 702 - protein, 12 aa, Human severe acute respiratory syndrome virus
SFVVTCEWPDTP

SEQ ID NO: 703 - protein, 24 aa, Human severe acute respiratory syndrome virus
GAVTLRTCQKRSLWLHHERFLITN

SEQ ID NO: 704 - protein, 5 aa, Human severe acute respiratory syndrome virus
ERRSV

SEQ ID NO: 705 - protein, 18 aa, Human severe acute respiratory syndrome virus
ALIQVLLHTTATVLETIN

SEQ ID NO: 706 - protein, 13 aa, Human severe acute respiratory syndrome virus
IQTTPVATTILLC

SEQ ID NO: 707 - protein, 65 aa, Human severe acute respiratory syndrome virus
QQMFHLVDFQVTIAEILIIIMRTFRIAIWNLDVIISSIVRQLFKPLTKKNYSELDDEEPMELDYP

SEQ ID NO: 708 - protein, 26 aa, Human severe acute respiratory syndrome virus
NEHENYSLPDIDCIYILRAISLSGVC

SEQ ID NO: 709 - protein, 25 aa, Human severe acute respiratory syndrome virus
RYDCTTKRTLPIRNIRGQFTISPSC

SEQ ID NO: 710 - protein, 6 aa, Human severe acute respiratory syndrome virus
ICTNLH

SEQ ID NO: 711 - protein, 8 aa, Human severe acute respiratory syndrome virus
HTLCFCLC

SEQ ID NO: 712 - protein, 48 aa, Human severe acute respiratory syndrome virus
RYSTYLSAACKISFTKTFHQTRGGSTRALLATFSHCCCSSIFNTLLHH

SEQ ID NO: 713 - protein, 48 aa, Human severe acute respiratory syndrome virus
EKDRMNELTLIDFYLCFLAFLLFLVLIMLIIFWFSLEIQDLEEPCTKV

SEQ ID NO: 714 - protein, 41 aa, Human severe acute respiratory syndrome virus
TNMKLLIVLTCISLCSCICTVVQRCASNKPHVLEDPCKVQH

SEQ ID NO: 715 - protein, 14 aa, Human severe acute respiratory syndrome virus
HCLALCSRKGFTFS

SEQ ID NO: 716 - protein, 10 aa, Human severe acute respiratory syndrome virus
MAHYGSNMHT

SEQ ID NO: 717 - protein, 15 aa, Human severe acute respiratory syndrome virus
CYYQLSRSSWWCAYS

SEQ ID NO: 718 - protein, 5 aa, Human severe acute respiratory syndrome virus
VLVPS

SEQ ID NO: 719 - protein, 7 aa, Human severe acute respiratory syndrome virus
RSPNCCI

SEQ ID NO: 720 - protein, 7 aa, Human severe acute respiratory syndrome virus
RRTCCFK

SEQ ID NO: 721 - protein, 106 aa, Human severe acute respiratory syndrome virus
TNKLKCLIMDPNQTNVVPPALHLVDPQIQLTITRMEDAMGQGQNSADPKVYPIILRLGSQLSLSMARRNLDSLEARAFQSTPIVVQMTKLATTEELPDEFVVVTAK

SEQ ID NO: 722 - protein, 11 aa, Human severe acute respiratory syndrome virus
KSSAPDGTSIT

SEQ ID NO: 723 - protein, 25 aa, Human severe acute respiratory syndrome virus
ELAQKLHFPTALTKKASYGLQLREP

SEQ ID NO: 724 - protein, 84 aa, Human severe acute respiratory syndrome virus
IHPKTTLAPAILITMLPPCYNFLKEQHCQKASTQREAEAAVKPLLAPHHVVAVIQEIQLLAAVGEILLLEWLAEVVKLPSRYCC

SEQ ID NO: 725 - protein, 63 aa, Human severe acute respiratory syndrome virus
TSLRAKFLVKANNNKAKLSLRNLLLRHLKSLAKNVLPQNSTTSLKHLGDVVQNKPKEISGTKT

SEQ ID NO: 726 - protein, 39 aa, Human severe acute respiratory syndrome virus
SDKELITNIGRKLHNLLQVPLHSLECHALAWKSHLREHG

SEQ ID NO: 727 - protein, 21 aa, Human severe acute respiratory syndrome virus
LIMEPLNWMTKIHNSKTTSYC

SEQ ID NO: 728 - protein, 38 aa, Human severe acute respiratory syndrome virus
TSTLTHTKHSHQQSLKRTKRKRLMKLSLCRRDKRSSPL

SEQ ID NO: 729 - protein, 18 aa, Human severe acute respiratory syndrome virus
LFFLRLTWMISPDNFKIP

SEQ ID NO: 730 - protein, 13 aa, Human severe acute respiratory syndrome virus
VELLLIQLRHKHS

SEQ ID NO: 731 - protein, 18 aa, Human severe acute respiratory syndrome virus
PHKADGLCKRFRNSVYDT

SEQ ID NO: 732 - protein, 9 aa, Human severe acute respiratory syndrome virus
STLVQNEFS

SEQ ID NO: 733 - protein, 8 aa, Human severe acute respiratory syndrome virus
LNSTSRFS

SEQ ID NO: 734 - protein, 15 aa, Human severe acute respiratory syndrome virus
SHIAIFNQCVTLGRT

SEQ ID NO: 735 - protein, 43 aa, Human severe acute respiratory syndrome virus
KSHHIFIEATRSTIEGTVNNARESCLYGRALMCKINFSSAIPM

SEQ ID NO: 736 - protein, 10 aa, Human severe acute respiratory syndrome virus
LLRRMTKKKK

SEQ ID NO: 737 - DNA, 29742 bp, Human severe acute respiratory syndrome virus; identical to SEQ ID NO: 15
  CDS (3)..(29741)

SEQ ID NO: 738 - protein, 16 aa, Human severe acute respiratory syndrome virus
IRFLPTQEKPTNLDLL

SEQ ID NO: 739 - protein, 7 aa, Human severe acute respiratory syndrome virus
ICSLNEL

SEQ ID NO: 740 - protein, 25 aa, Human severe acute respiratory syndrome virus
NLCSCRSAACLVHLRSINNNKFYCR

SEQ ID NO: 741 - protein, 35 aa, Human severe acute respiratory syndrome virus
QETSNSSLFCRLLTVSSVLQSIISIPRFRPGVTER

SEQ ID NO: 742 - protein, 23 aa, Human severe acute respiratory syndrome virus
DGEPCSWCQRENTRPTQFACPSG

SEQ ID NO: 743 - protein, 19 aa, Human severe acute respiratory syndrome virus
RRASAWLRGLCGRGPIGGT

SEQ ID NO: 744 - protein, 20 aa, Human severe acute respiratory syndrome virus
TPQKWHLWSSRAGKRRTAPA

SEQ ID NO: 745 - protein, 6 aa, Human severe acute respiratory syndrome virus
TALCVH

SEQ ID NO: 746 - protein, 11 aa, Human severe acute respiratory syndrome virus
CLKHQSRPQGR

SEQ ID NO: 747 - protein, 12 aa, Human severe acute respiratory syndrome virus
AGCRNGRHSVRS

SEQ ID NO: 748 - protein, 24 aa, Human severe acute respiratory syndrome virus
RYNTGSTRATCGRNPNCIPQCSSS

SEQ ID NO: 749 - protein, 5 aa, Human severe acute respiratory syndrome virus
GSRWS

SEQ ID NO: 750 - protein, 8 aa, Human severe acute respiratory syndrome virus
LWHRSKVL

SEQ ID NO: 751 - protein, 4 aa, Human severe acute respiratory syndrome virus
RAWH

SEQ ID NO: 752 - protein, 5 aa, Human severe acute respiratory syndrome virus
TKLEH

SEQ ID NO: 753 - protein, 7 aa, Human severe acute respiratory syndrome virus
AWQWCTP

SEQ ID NO: 754 - protein, 22 aa, Human severe acute respiratory syndrome virus
AQWRCSHSLCRQQFLWPRWVPS

SEQ ID NO: 755 - protein, 20 aa, Human severe acute respiratory syndrome virus
LHQRFSRTRGQVNVHSFRTT

SEQ ID NO: 756 - protein, 12 aa, Human severe acute respiratory syndrome virus
LHRVEERCLLLP

SEQ ID NO: 757 - protein, 5 aa, Human severe acute respiratory syndrome virus
NCLVH

SEQ ID NO: 758 - protein, 10 aa, Human severe acute respiratory syndrome virus
ELRAPDTLRN

SEQ ID NO: 759 - protein, 5 aa, Human severe acute respiratory syndrome virus
ECQEI

SEQ ID NO: 760 - protein, 13 aa, Human severe acute respiratory syndrome virus
HFQRGMPKVCVSS

SEQ ID NO: 761 - protein, 10 aa, Human severe acute respiratory syndrome virus
LKSQSHSTTC

SEQ ID NO: 762 - protein, 4 aa, Human severe acute respiratory syndrome virus
KEKD

SEQ ID NO: 763 - protein, 18 aa, Human severe acute respiratory syndrome virus
GFHGAYTLCVPCCISTGV

SEQ ID NO: 764 - protein, 10 aa, Human severe acute respiratory syndrome virus
QYALVYLDEM

SEQ ID NO: 765 - protein, 13 aa, Human severe acute respiratory syndrome virus
SFMADVRLSESHL

SEQ ID NO: 766 - protein, 4 aa, Human severe acute respiratory syndrome virus
TLWH

SEQ ID NO: 767 - protein, 4 aa, Human severe acute respiratory syndrome virus
KFSY

SEQ ID NO: 768 - protein, 10 aa, Human severe acute respiratory syndrome virus
RTYYMWVPTY

SEQ ID NO: 769 - protein, 17 aa, Human severe acute respiratory syndrome virus
CCSENAMSCLSRPRDWT

SEQ ID NO: 770 - protein, 10 aa, Human severe acute respiratory syndrome virus
CCRLSQPLKH

SEQ ID NO: 771 - protein, 7 aa, Human severe acute respiratory syndrome virus
NSTPQGR

SEQ ID NO: 772 - protein, 13 aa, Human severe acute respiratory syndrome virus
MFWRLCVCLCWLL

SEQ ID NO: 773 - protein, 8 aa, Human severe acute respiratory syndrome virus
ACLLGSSC

SEQ ID NO: 774 - protein, 10 aa, Human severe acute respiratory syndrome virus
YWLRPYWHYW

SEQ ID NO: 775 - protein, 6 aa, Human severe acute respiratory syndrome virus
QCGDLE

SEQ ID NO: 776 - protein, 4 aa, Human severe acute respiratory syndrome virus
DTES

SEQ ID NO: 777 - protein, 8 aa, Human severe acute respiratory syndrome virus
HCWRFSFE

SEQ ID NO: 778 - protein, 17 aa, Human severe acute respiratory syndrome virus
RGCHHFGIFLCFYKCLY

SEQ ID NO: 779 - protein, 5 aa, Human severe acute respiratory syndrome virus
HYKES

SEQ ID NO: 780 - protein, 8 aa, Human severe acute respiratory syndrome virus
LQVFQNHC

SEQ ID NO: 781 - protein, 42 aa, Human severe acute respiratory syndrome virus
SYQGKARKRCLEHWTTEISFNTTVWFSLTGCWCYQINFCAHT

SEQ ID NO: 782 - protein, 7 aa, Human severe acute respiratory syndrome virus
CSKPLNS

SEQ ID NO: 783 - protein, 9 aa, Human severe acute respiratory syndrome virus
FAKSSCHHT

SEQ ID NO: 784 - protein, 39 aa, Human severe acute respiratory syndrome virus
TVITSCRRHGLYFRPAHQQCHYYGICNWWSCTTDFSVVV

SEQ ID NO: 785 - protein, 6 aa, Human severe acute respiratory syndrome virus
SFGHYC

SEQ ID NO: 786 - protein, 6 aa, Human severe acute respiratory syndrome virus
KTQAYL

SEQ ID NO: 787 - protein, 17 aa, Human severe acute respiratory syndrome virus
ISQGCLGDSQISHYRCF

SEQ ID NO: 788 - protein, 11 aa, Human severe acute respiratory syndrome virus
HRQGSNTGCFR

SEQ ID NO: 789 - protein, 9 aa, Human severe acute respiratory syndrome virus
HQGLCKMLH

SEQ ID NO: 790 - protein, 7 aa, Human severe acute respiratory syndrome virus
QGTRNVH

SEQ ID NO: 791 - protein, 15 aa, Human severe acute respiratory syndrome virus
SSHYRWRKVAITQLR

SEQ ID NO: 792 - protein, 26 aa, Human severe acute respiratory syndrome virus
SLHRSKQGTLPSVYTWQGAAATTHAS

SEQ ID NO: 793 - protein, 8 aa, Human severe acute respiratory syndrome virus
GTKRSNLS

SEQ ID NO: 794 - protein, 5 aa, Human severe acute respiratory syndrome virus
HSTYL

SEQ ID NO: 795 - protein, 7 aa, Human severe acute respiratory syndrome virus
GGCSQER

SEQ ID NO: 796 - protein, 8 aa, Human severe acute respiratory syndrome virus
TRSTRDAR

SEQ ID NO: 797 - protein, 21 aa, Human severe acute respiratory syndrome virus
LHKWSYRRHTSLCKWPHALRD

SEQ ID NO: 798 - protein, 27 aa, Human severe acute respiratory syndrome virus
GQRTILRIVSWFTGYKQCLSLKRGCTN

SEQ ID NO: 799 - protein, 22 aa, Human severe acute respiratory syndrome virus
RCNLWRRYCLGSSRLQECENHI

SEQ ID NO: 800 - protein, 7 aa, Human severe acute respiratory syndrome virus
KVLCLHC

SEQ ID NO: 801 - protein, 6 aa, Human severe acute respiratory syndrome virus
IRYRSY

SEQ ID NO: 802 - protein, 17 aa, Human severe acute respiratory syndrome virus
VCMCCSRGCCEDFTTSF

SEQ ID NO: 803 - protein, 7 aa, Human severe acute respiratory syndrome virus
SPYQHGY

SEQ ID NO: 804 - protein, 9 aa, Human severe acute respiratory syndrome virus
VECSYILLI

SEQ ID NO: 805 - protein, 15 aa, Human severe acute respiratory syndrome virus
RKLFITYVLFLLPSR

SEQ ID NO: 806 - protein, 8 aa, Human severe acute respiratory syndrome virus
GRRGRCRV

SEQ ID NO: 807 - protein, 4 aa, Human severe acute respiratory syndrome virus
GRRN

SEQ ID NO: 808 - protein, 5 aa, Human severe acute respiratory syndrome virus
VRYRG

SEQ ID NO: 809 - protein, 12 aa, Human severe acute respiratory syndrome virus
LSRSPSGIWCLS

SEQ ID NO: 810 - protein, 4 aa, Human severe acute respiratory syndrome virus
NSSS

SEQ ID NO: 811 - protein, 9 aa, Human severe acute respiratory syndrome virus
GRRRGRLAG

SEQ ID NO: 812 - protein, 4 aa, Human severe acute respiratory syndrome virus
AIRD

SEQ ID NO: 813 - protein, 7 aa, Human severe acute respiratory syndrome virus
ARTRTYT

SEQ ID NO: 814 - protein, 9 aa, Human severe acute respiratory syndrome virus
SVYWLFKTY

SEQ ID NO: 815 - protein, 4 aa, Human severe acute respiratory syndrome virus
QCCH

SEQ ID NO: 816 - protein, 5 aa, Human severe acute respiratory syndrome virus
GGTKC

SEQ ID NO: 817 - protein, 8 aa, Human severe acute respiratory syndrome virus
SYGDCKCC

SEQ ID NO: 818 - protein, 25 aa, Human severe acute respiratory syndrome virus
HTPETWWWCSRCTQQGNQWCHAKGE

SEQ ID NO: 819 - protein, 16 aa, Human severe acute respiratory syndrome virus
AKWPSYSRRVLFAFWT

SEQ ID NO: 820 - protein, 8 aa, Human severe acute respiratory syndrome virus
EVSACCWT

SEQ ID NO: 821 - protein, 4 aa, Human severe acute respiratory syndrome virus
PKCR

SEQ ID NO: 822 - protein, 5 aa, Human severe acute respiratory syndrome virus
GHPAS

SEQ ID NO: 823 - protein, 20 aa, Human severe acute respiratory syndrome virus
KFQFTGHLTCTIVVSRHIWC

SEQ ID NO: 824 - protein, 21 aa, Human severe acute respiratory syndrome virus
TTSVFTSVRADGSYTGLYCSQ

SEQ ID NO: 825 - protein, 4 aa, Human severe acute respiratory syndrome virus
QSSL

SEQ ID NO: 826 - protein, 7 aa, Human severe acute respiratory syndrome virus
AGCHGLS

SEQ ID NO: 827 - protein, 4 aa, Human severe acute respiratory syndrome virus
SGST

SEQ ID NO: 828 - protein, 12 aa, Human severe acute respiratory syndrome virus
TRGATKHRRFQN

SEQ ID NO: 829 - protein, 15 aa, Human severe acute respiratory syndrome virus
GEICRTEACRCEAKN

SEQ ID NO: 830 - protein, 8 aa, Human severe acute respiratory syndrome virus
GYHNTGRN

SEQ ID NO: 831 - protein, 4 aa, Human severe acute respiratory syndrome virus
VSYQ

SEQ ID NO: 832 - protein, 5 aa, Human severe acute respiratory syndrome virus
VTLVC

SEQ ID NO: 833 - protein, 5 aa, Human severe acute respiratory syndrome virus
FSEHA

SEQ ID NO: 834 - protein, 5 aa, Human severe acute respiratory syndrome virus
RYVFP

SEQ ID NO: 835 - protein, 8 aa, Human severe acute respiratory syndrome virus
EGCTLHGR

SEQ ID NO: 836 - protein, 15 aa, Human severe acute respiratory syndrome virus
YHLCCNTLQKGWWHY

SEQ ID NO: 837 - protein, 11 aa, Human severe acute respiratory syndrome virus
DALKSFEESAS

SEQ ID NO: 838 - protein, 15 aa, Human severe acute respiratory syndrome virus
VYNHVPWTRMCWLYT

SEQ ID NO: 839 - protein, 14 aa, Human severe acute respiratory syndrome virus
EMQICILCTTFRST

SEQ ID NO: 840 - protein, 18 aa, Human severe acute respiratory syndrome virus
GRDSRNCILEFERNACSC

SEQ ID NO: 841 - protein, 12 aa, Human severe acute respiratory syndrome virus
RDKKINAYMHGC

SEQ ID NO: 842 - protein, 8 aa, Human severe acute respiratory syndrome virus
SHNGNHPT

SEQ ID NO: 843 - protein, 6 aa, Human severe acute respiratory syndrome virus
NSRGHR

SEQ ID NO: 844 - protein, 9 aa, Human severe acute respiratory syndrome virus
LWCPILLLY

SEQ ID NO: 845 - protein, 14 aa, Human severe acute respiratory syndrome virus
RACSFYYYEAELSK

SEQ ID NO: 846 - protein, 14 aa, Human severe acute respiratory syndrome virus
AACHNANWLCDTWF

SEQ ID NO: 847 - protein, 9 aa, Human severe acute respiratory syndrome virus
RGCALYAFS

SEQ ID NO: 848 - protein, 16 aa, Human severe acute respiratory syndrome virus
SSCRSVSIITRCCYYI

SEQ ID NO: 849 - protein, 10 aa, Human severe acute respiratory syndrome virus
WIPHFVIKDI

SEQ ID NO: 850 - protein, 27 aa, Human severe acute respiratory syndrome virus
GALCRNSFFGWLLQRLVLFRTAYRVRC

SEQ ID NO: 851 - protein, 15 aa, Human severe acute respiratory syndrome virus
QNCVPHSGEPRRVSS

SEQ ID NO: 852 - protein, 4 aa, Human severe acute respiratory syndrome virus
GSFT

SEQ ID NO: 853 - protein, 11 aa, Human severe acute respiratory syndrome virus
QTKESLIPAGG

SEQ ID NO: 854 - protein, 11 aa, Human severe acute respiratory syndrome virus
DYKSVHNCGQH

SEQ ID NO: 855 - protein, 24 aa, Human severe acute respiratory syndrome virus
SPHTACGYVYDIWTAVWSNILGWC

SEQ ID NO: 856 - protein, 4 aa, Human severe acute respiratory syndrome virus
CYKN

SEQ ID NO: 857 - protein, 5 aa, Human severe acute respiratory syndrome virus
TSCKS

SEQ ID NO: 858 - protein, 6 aa, Human severe acute respiratory syndrome virus
DFLCTT

SEQ ID NO: 859 - protein, 8 aa, Human severe acute respiratory syndrome virus
SFRVLPYS

SEQ ID NO: 860 - protein, 4 aa, Human severe acute respiratory syndrome virus
EFSW

SEQ ID NO: 861 - protein, 22 aa, Human severe acute respiratory syndrome virus
VHVCFKPHKEMEISSSWWFNFN

SEQ ID NO: 862 - protein, 5 aa, Human severe acute respiratory syndrome virus
QLLFV

SEQ ID NO: 863 - protein, 8 aa, Human severe acute respiratory syndrome virus
CFISTSTA

SEQ ID NO: 864 - protein, 13 aa, Human severe acute respiratory syndrome virus
SQIQCTSTSRGLL

SEQ ID NO: 865 - protein, 4 aa, Human severe acute respiratory syndrome virus
SPCW

SEQ ID NO: 866 - protein, 9 aa, Human severe acute respiratory syndrome virus
LLCTHTRLQ

SEQ ID NO: 867 - protein, 6 aa, Human severe acute respiratory syndrome virus
NCWRAW

SEQ ID NO: 868 - protein, 12 aa, Human severe acute respiratory syndrome virus
CQRNYDPSSTAC

SEQ ID NO: 869 - protein, 8 aa, Human severe acute respiratory syndrome virus
FGICKASS

SEQ ID NO: 870 - protein, 23 aa, Human severe acute respiratory syndrome virus
TLWSENYYLNGCRSCDVYGYSIL

SEQ ID NO: 871 - protein, 11 aa, Human severe acute respiratory syndrome virus
DRCFHSMCVWS

SEQ ID NO: 872 - protein, 20 aa, Human severe acute respiratory syndrome virus
CYTISSTTRVFFCYDVCTTC

SEQ ID NO: 873 - protein, 10 aa, Human severe acute respiratory syndrome virus
ITARYILMCE

SEQ ID NO: 874 - protein, 11 aa, Human severe acute respiratory syndrome virus
LSVWSLHSYNC

SEQ ID NO: 875 - protein, 6 aa, Human severe acute respiratory syndrome virus
GDPLSY

SEQ ID NO: 876 - protein, 15 aa, Human severe acute respiratory syndrome virus
RSSPYKDVRVQRTSD

SEQ ID NO: 877 - protein, 17 aa, Human severe acute respiratory syndrome virus
CFLQGNILHYNHQACVV

SEQ ID NO: 878 - protein, 9 aa, Human severe acute respiratory syndrome virus
TRWSYLHRD

SEQ ID NO: 879 - protein, 7 aa, Human severe acute respiratory syndrome virus
TKIGWVL

SEQ ID NO: 880 - protein, 21 aa, Human severe acute respiratory syndrome virus
CLLYRAAYRPCTNSTITKCEF

SEQ ID NO: 881 - protein, 6 aa, Human severe acute respiratory syndrome virus
FQTHMF

SEQ ID NO: 882 - protein, 4 aa, Human severe acute respiratory syndrome virus
HKIC

SEQ ID NO: 883 - protein, 30 aa, Human severe acute respiratory syndrome virus
FKSNDRLHKASFTRAICHILPRLEWRCSGY

SEQ ID NO: 884 - protein, 10 aa, Human severe acute respiratory syndrome virus
TLFSEFQERC

SEQ ID NO: 885 - protein, 6 aa, Human severe acute respiratory syndrome virus
ANCLAH

SEQ ID NO: 886 - protein, 30 aa, Human severe acute respiratory syndrome virus
PGYNQDNVQTKHLVFTLSLEYKASRYFKFI

SEQ ID NO: 887 - protein, 15 aa, Human severe acute respiratory syndrome virus
SSGSRRHTRNGQSCL

SEQ ID NO: 888 - protein, 6 aa, Human severe acute respiratory syndrome virus
KSTTHL

SEQ ID NO: 889 - protein, 15 aa, Human severe acute respiratory syndrome virus
RSSGKSYHTEGSHRV

SEQ ID NO: 890 - protein, 12 aa, Human severe acute respiratory syndrome virus
RENYRSCRQCHT

SEQ ID NO: 891 - protein, 7 aa, Human severe acute respiratory syndrome virus
SNTRVRS

SEQ ID NO: 892 - protein, 14 aa, Human severe acute respiratory syndrome virus
GSYGCLCGKHKHYH

SEQ ID NO: 893 - protein, 18 aa, Human severe acute respiratory syndrome virus
AFTSLRFKNNCHSWYCCN

SEQ ID NO: 894 - protein, 4 aa, Human severe acute respiratory syndrome virus
CSLE

SEQ ID NO: 895 - protein, 20 aa, Human severe acute respiratory syndrome virus
NFGLCQTILRTSSNYNIKLR

SEQ ID NO: 896 - protein, 7 aa, Human severe acute respiratory syndrome virus
EISTTCV

SEQ ID NO: 897 - protein, 17 aa, Human severe acute respiratory syndrome virus
QLYALCVYIIVPIVYFY

SEQ ID NO: 898 - protein, 4 aa, Human severe acute respiratory syndrome virus
KYQF

SEQ ID NO: 899 - protein, 8 aa, Human severe acute respiratory syndrome virus
SFTTYNYC

SEQ ID NO: 900 - protein, 7 aa, Human severe acute respiratory syndrome virus
IMFGCRH

SEQ ID NO: 901 - protein, 8 aa, Human severe acute respiratory syndrome virus
LCEVTQIF

SEQ ID NO: 902 - protein, 30 aa, Human severe acute respiratory syndrome virus
IVHNRYVAIVVKYLLRFSNLCNCCFWCTLI

SEQ ID NO: 903 - protein, 7 aa, Human severe acute respiratory syndrome virus
FWCSFLL

SEQ ID NO: 904 - protein, 4 aa, Human severe acute respiratory syndrome virus
RIVS

SEQ ID NO: 905 - protein, 7 aa, Human severe acute respiratory syndrome virus
RYYYGFL

SEQ ID NO: 906 - protein, 15 aa, Human severe acute respiratory syndrome virus
RFFSLQHLFKWIRLP

SEQ ID NO: 907 - protein, 5 aa, Human severe acute respiratory syndrome virus
FLSSS

SEQ ID NO: 908 - protein, 20 aa, Human severe acute respiratory syndrome virus
NHSGDDFIVQARLDNFRSGR

SEQ ID NO: 909 - protein, 29 aa, Human severe acute respiratory syndrome virus
VGFGIYVVHKILLFIRSFSYNAGVLWLFC

SEQ ID NO: 910 - protein, 13 aa, Human severe acute respiratory syndrome virus
SFHQQFLAHVVYH

SEQ ID NO: 911 - protein, 11 aa, Human severe acute respiratory syndrome virus
YCTNGTRFCNG

SEQ ID NO: 912 - protein, 31 aa, Human severe acute respiratory syndrome virus
DVHLLCFFLLHMEELCSYHGWLHLFDLHDVL

SEQ ID NO: 913 - protein, 7 aa, Human severe acute respiratory syndrome virus
AQSCHTR

SEQ ID NO: 914 - protein, 5 aa, Human severe acute respiratory syndrome virus
VYNYC

SEQ ID NO: 915 - protein, 27 aa, Human severe acute respiratory syndrome virus
WHEEIFLCLCKWRPWLLQDSQLELSQL

SEQ ID NO: 916 - protein, 5 aa, Human severe acute respiratory syndrome virus
HILHW

SEQ ID NO: 917 - protein, 5 aa, Human severe acute respiratory syndrome virus
FVTPV

SEQ ID NO: 918 - protein, 6 aa, Human severe acute respiratory syndrome virus
KTNQPY

SEQ ID NO: 919 - protein, 6 aa, Human severe acute respiratory syndrome virus
PVIVYC

SEQ ID NO: 920 - protein, 12 aa, Human severe acute respiratory syndrome virus
CCCEKWRASPLL

SEQ ID NO: 921 - protein, 7 aa, Human severe acute respiratory syndrome virus
QGWSKDL

SEQ ID NO: 922 - protein, 15 aa, Human severe acute respiratory syndrome virus
ETSALPFCQFRQFES

SEQ ID NO: 923 - protein, 5 aa, Human severe acute respiratory syndrome virus
RFTAY

SEQ ID NO: 924 - protein, 4 aa, Human severe acute respiratory syndrome virus
CHSF

SEQ ID NO: 925 - protein, 10 aa, Human severe acute respiratory syndrome virus
WQVQMRRVCF

SEQ ID NO: 926 - protein, 17 aa, Human severe acute respiratory syndrome virus
VCFCVLQSADVPTYSVA

SEQ ID NO: 927 - protein, 9 aa, Human severe acute respiratory syndrome virus
PSSCIKRWR

SEQ ID NO: 928 - protein, 10 aa, Human severe acute respiratory syndrome virus
CLCRHLFSNF

SEQ ID NO: 929 - protein, 6 aa, Human severe acute respiratory syndrome virus
CSYGKT

SEQ ID NO: 930 - protein, 32 aa, Human severe acute respiratory syndrome virus
GTCCYSSQRVSKGCSFRWCPFYIRVSCPTRCC

SEQ ID NO: 931 - protein, 5 aa, Human severe acute respiratory syndrome virus
HKGCY

SEQ ID NO: 932 - protein, 8 aa, Human severe acute respiratory syndrome virus
MSQTFTSL

SEQ ID NO: 933 - protein, 5 aa, Human severe acute respiratory syndrome virus
LRSDR

SEQ ID NO: 934 - protein, 6 aa, Human severe acute respiratory syndrome virus
QFHAHL

SEQ ID NO: 935 - protein, 11 aa, Human severe acute respiratory syndrome virus
KHDAQRSWRMY

SEQ ID NO: 936 - protein, 27 aa, Human severe acute respiratory syndrome virus
CKAYQCPSSKKSQCFTHLECKRLHVFI

SEQ ID NO: 937 - protein, 20 aa, Human severe acute respiratory syndrome virus
TNSYCCQEEQHTFYTNLCYN

SEQ ID NO: 938 - protein, 8 aa, Human severe acute respiratory syndrome virus
TGCQCHNY

SEQ ID NO: 939 - protein, 6 aa, Human severe acute respiratory syndrome virus
NLTQGW

SEQ ID NO: 940 - protein, 24 aa, Human severe acute respiratory syndrome virus
GHIIVRSCCIGLLYRYASTYIVNP

SEQ ID NO: 941 - protein, 4 aa, Human severe acute respiratory syndrome virus
WLHK

SEQ ID NO: 942 - protein, 13 aa, Human severe acute respiratory syndrome virus
NHWLQSHSGWCHS

SEQ ID NO: 943 - protein, 4 aa, Human severe acute respiratory syndrome virus
HHFY

SEQ ID NO: 944 - protein, 4 aa, Human severe acute respiratory syndrome virus
LFCK

SEQ ID NO: 945 - protein, 4 aa, Human severe acute respiratory syndrome virus
TCWF

SEQ ID NO: 946 - protein, 8 aa, Human severe acute respiratory syndrome virus
PAWWFIQK

SEQ ID NO: 947 - protein, 31 aa, Human severe acute respiratory syndrome virus
QKLPCSSCYHYKRDWFHSAWLTGYCAESNQW

SEQ ID NO: 948 - protein, 9 aa, Human severe acute respiratory syndrome virus
LLAFSTSCF

SEQ ID NO: 949 - protein, 13 aa, Human severe acute respiratory syndrome virus
CCWQHLLHTFQTH

SEQ ID NO: 950 - protein, 10 aa, Human severe acute respiratory syndrome virus
FCYLCLRSCC

SEQ ID NO: 951 - protein, 4 aa, Human severe acute respiratory syndrome virus
VYNF

SEQ ID NO: 952 - protein, 11 aa, Human severe acute respiratory syndrome virus
GCYGQTCAILL

SEQ ID NO: 953 - protein, 8 aa, Human severe acute respiratory syndrome virus
FARGFYFL

SEQ ID NO: 954 - protein, 18 aa, Human severe acute respiratory syndrome virus
ASSRHSLCAYGWFHHTVS

SEQ ID NO: 955 - protein, 7 aa, Human severe acute respiratory syndrome virus
HLPGGFC

SEQ ID NO: 956 - protein, 5 aa, Human severe acute respiratory syndrome virus
SSNNF

SEQ ID NO: 957 - protein, 17 aa, Human severe acute respiratory syndrome virus
TWYMRKVRSRYLPIYQW

SEQ ID NO: 958 - protein, 12 aa, Human severe acute respiratory syndrome virus
ALQSSIRSFLWC

SEQ ID NO: 959 - protein, 6 aa, Human severe acute respiratory syndrome virus
CDESHS

SEQ ID NO: 960 - protein, 43 aa, Human severe acute respiratory syndrome virus
HLYSSCATCGCFRCVCFSSGWWYYCHIGDLCCLLLYEIQTCFW

SEQ ID NO: 961 - protein, 7 aa, Human severe acute respiratory syndrome virus
VQPCCCC

SEQ ID NO: 962 - protein, 37 aa, Human severe acute respiratory syndrome virus
CTFVFDVFHYTLSGTSLQLSAGSLLSLLLVLDILFHQ

SEQ ID NO: 963 - protein, 38 aa, Human severe acute respiratory syndrome virus
CFILGSPSMVCHVFSYCAFLDNSNLCILYFSEALPLVL

SEQ ID NO: 964 - protein, 5 aa, Human severe acute respiratory syndrome virus
EKSHV

SEQ ID NO: 965 - protein, 4 aa, Human severe acute respiratory syndrome virus
WSYI

SEQ ID NO: 966 - protein, 21 aa, Human severe acute respiratory syndrome virus
YLRGGCFVYLFAQQGNVPKIA

SEQ ID NO: 967 - protein, 9 aa, Human severe acute respiratory syndrome virus
RDTVATYTV

SEQ ID NO: 968 - protein, 6 aa, Human severe acute respiratory syndrome virus
QVSCSI

SEQ ID NO: 969 - protein, 15 aa, Human severe acute respiratory syndrome virus
QVQVFQWSLRYYQLS

SEQ ID NO: 970 - protein, 11 aa, Human severe acute respiratory syndrome virus
SSLLPLSKGSK

SEQ ID NO: 971 - protein, 4 aa, Human severe acute respiratory syndrome virus
QLRC

SEQ ID NO: 972 - protein, 19 aa, Human severe acute respiratory syndrome virus
CSLPTTTDINHFCCSAEWF

SEQ ID NO: 973 - protein, 9 aa, Human severe acute respiratory syndrome virus
ENGIPVRQS

SEQ ID NO: 974 - protein, 13 aa, Human severe acute respiratory syndrome virus
RVHGTSNLWNYNS

SEQ ID NO: 975 - protein, 5 aa, Human severe acute respiratory syndrome virus
WIVVG

SEQ ID NO: 976 - protein, 16 aa, Human severe acute respiratory syndrome virus
HSILSKTCHLHSRRHA

SEQ ID NO: 977 - protein, 9 aa, Human severe acute respiratory syndrome virus
RSAHSQIQP

SEQ ID NO: 978 - protein, 22 aa, Human severe acute respiratory syndrome virus
LSCSGWQCSTSCYWPFYAKLSA

SEQ ID NO: 979 - protein, 4 aa, Human severe acute respiratory syndrome virus
DTQV

SEQ ID NO: 980 - protein, 30 aa, Human severe acute respiratory syndrome virus
ICPYPTWSNIFSSSMLQWFTIWCLSVCHET

SEQ ID NO: 981 - protein, 4 aa, Human severe acute respiratory syndrome virus
RFFP

SEQ ID NO: 982 - protein, 4 aa, Human severe acute respiratory syndrome virus
WIMW

SEQ ID NO: 983 - protein, 20 aa, Human severe acute respiratory syndrome virus
LRVFLLYASYGASNRSTRWY

SEQ ID NO: 984 - protein, 6 aa, Human severe acute respiratory syndrome virus
ILWSIC

SEQ ID NO: 985 - protein, 28 aa, Human severe acute respiratory syndrome virus
QTNCTGCRYRHNHNIKCFGMAVCCCYQW

SEQ ID NO: 986 - protein, 6 aa, Human severe acute respiratory syndrome virus
IHHYFE

SEQ ID NO: 987 - protein, 8 aa, Human severe acute respiratory syndrome virus
PCGNEVQL

SEQ ID NO: 988 - protein, 7 aa, Human severe acute respiratory syndrome virus
TFDTRSC

SEQ ID NO: 989 - protein, 35 aa, Human severe acute respiratory syndrome virus
HIGTSFCSNRNCRLRYVCCFERAAAEWYEWSYYPW

SEQ ID NO: 990 - protein, 5 aa, Human severe acute respiratory syndrome virus
HYFRR

SEQ ID NO: 991 - protein, 4 aa, Human severe acute respiratory syndrome virus
VYTI

SEQ ID NO: 992 - protein, 9 aa, Human severe acute respiratory syndrome virus
TMLWCYLPR

SEQ ID NO: 993 - protein, 5 aa, Human severe acute respiratory syndrome virus
VQENC

SEQ ID NO: 994 - protein, 52 aa, Human severe acute respiratory syndrome virus
GHSSLDAFNFLDITIDSCSKYTVVTVFLCLRECFLAIYSWYYGNCCMCYAAC

SEQ ID NO: 995 - protein, 18 aa, Human severe acute respiratory syndrome virus
ARILVLVSVTFSCNSCLL

SEQ ID NO: 996 - protein, 6 aa, Human severe acute respiratory syndrome virus
YGLHAC

SEQ ID NO: 997 - protein, 9 aa, Human severe acute respiratory syndrome virus
LGDAYHDMA

SEQ ID NO: 998 - protein, 4 aa, Human severe acute respiratory syndrome virus
LVWL

SEQ ID NO: 999 - protein, 21 aa, Human severe acute respiratory syndrome virus
GLCYVCFSFSFAYSHDSSHCL

SEQ ID NO: 1000 - protein, 18 aa, Human severe acute respiratory syndrome virus
TCLDTDECHYTCLQSLLW

SEQ ID NO: 1001 - protein, 17 aa, Human severe acute respiratory syndrome virus
CFRSSYFHVGLSYFCNL

SEQ ID NO: 1002 - protein, 12 aa, Human severe acute respiratory syndrome virus
LFWCRYDYHVFS

SEQ ID NO: 1003 - protein, 7 aa, Human severe acute respiratory syndrome virus
SYSVCVC

SEQ ID NO: 1004 - protein, 47 aa, Human severe acute respiratory syndrome virus
VLPIVIYYWQHLTVYHACLLFLRLLLLLLLWPFLFTQPLLQAYSWCL

SEQ ID NO: 1005 - protein, 8 aa, Human severe acute respiratory syndrome virus
LLGLYTRI

SEQ ID NO: 1006 - protein, 10 aa, Human severe acute respiratory syndrome virus
VYELPGAFAS

SEQ ID NO: 1007 - protein, 4 aa, Human severe acute respiratory syndrome virus
CFQA

SEQ ID NO: 1008 - protein, 6 aa, Human severe acute respiratory syndrome virus
VVGYWR

SEQ ID NO: 1009 - protein, 10 aa, Human severe acute respiratory syndrome virus
TMYQGCYCTV

SEQ ID NO: 1010 - protein, 15 aa, Human severe acute respiratory syndrome virus
RKVHICGTALGSSTT

SEQ ID NO: 1011 - protein, 5 aa, Human severe acute respiratory syndrome virus
SRVIF

SEQ ID NO: 1012 - protein, 10 aa, Human severe acute respiratory syndrome virus
IVGTMCTTPQ

SEQ ID NO: 1013 - protein, 8 aa, Human severe acute respiratory syndrome virus
YSSCKRHN

SEQ ID NO: 1014 - protein, 21 aa, Human severe acute respiratory syndrome virus
SFREDGFSFVCFAIHAGCCRH

SEQ ID NO: 1015 - protein, 7 aa, Human severe acute respiratory syndrome virus
VVRGNAR

SEQ ID NO: 1016 - protein, 11 aa, Human severe acute respiratory syndrome virus
PCYSSGYCFRI

SEQ ID NO: 1017 - protein, 15 aa, Human severe acute respiratory syndrome virus
FFTIICRLCHCPGGL

SEQ ID NO: 1018 - protein, 4 aa, Human severe acute respiratory syndrome virus
AGCS

SEQ ID NO: 1019 - protein, 13 aa, Human severe acute respiratory syndrome virus
SRSQKVKEIFECG

SEQ ID NO: 1020 - protein, 24 aa, Human severe acute respiratory syndrome virus
CCHATQVGKDGRSGYDPNVQTGKI

SEQ ID NO: 1021 - protein, 7 aa, Human severe acute respiratory syndrome virus
GQEGKSN

SEQ ID NO: 1022 - protein, 10 aa, Human severe acute respiratory syndrome virus
CYANNALHYA

SEQ ID NO: 1023 - protein, 7 aa, Human severe acute respiratory syndrome virus
QHYQQCA

SEQ ID NO: 1024 - protein, 21 aa, Human severe acute respiratory syndrome virus
WLCSTQHHTIDYSSQTHGCCP

SEQ ID NO: 1025 - protein, 8 aa, Human severe acute respiratory syndrome virus
LWYLQEHL

SEQ ID NO: 1026 - protein, 15 aa, Human severe acute respiratory syndrome virus
HLYICICTLGNPASC

SEQ ID NO: 1027 - protein, 5 aa, Human severe acute respiratory syndrome virus
QDCST

SEQ ID NO: 1028 - protein, 22 aa, Human severe acute respiratory syndrome virus
HGQFTKFGLASYCYSSKSQLSC

SEQ ID NO: 1029 - protein, 21 aa, Human severe acute respiratory syndrome virus
TESSSTTTDVLCGWYHTNSLY

SEQ ID NO: 1030 - protein, 6 aa, Human severe acute respiratory syndrome virus
QCTCLL

SEQ ID NO: 1031 - protein, 5 aa, Human severe acute respiratory syndrome virus
QFEGR

SEQ ID NO: 1032 - protein, 15 aa, Human severe acute respiratory syndrome virus
VCAGITIRPPRSQMG

SEQ ID NO: 1033 - protein, 13 aa, Human severe acute respiratory syndrome virus
WYRYNLHRTGTTL

SEQ ID NO: 1034 - protein, 9 aa, Human severe acute respiratory syndrome virus
VCYRHTKRA

SEQ ID NO: 1035 - protein, 14 aa, Human severe acute respiratory syndrome virus
SEILVLHQRLKQPK

SEQ ID NO: 1036 - protein, 38 aa, Human severe acute respiratory syndrome virus
RYGAGQFSCYSTSSGWKCYRSTCQFNCAFLLCFCSRPC

SEQ ID NO: 1037 - protein, 33 aa, Human severe acute respiratory syndrome virus
GLPSKWRTTNHQLCEDVVYTHWYRTGNYCNTRS

SEQ ID NO: 1038 - protein, 15 aa, Human severe acute respiratory syndrome virus
HGPRVLWWCFMLSVL

SEQ ID NO: 1039 - protein, 4 aa, Human severe acute respiratory syndrome virus
PSKS

SEQ ID NO: 1040 - protein, 9 aa, Human severe acute respiratory syndrome virus
VRPNTYHLC

SEQ ID NO: 1041 - protein, 6 aa, Human severe acute respiratory syndrome virus
PSGFYT

SEQ ID NO: 1042 - protein, 15 aa, Human severe acute respiratory syndrome virus
KHSLYRLRNVERLWL

SEQ ID NO: 1043 - protein, 2712 aa, Human severe acute respiratory syndrome virus
PTPRTLDAVCGCINVFKRVCGVSAARLTPCGTGTSTDVVYRAFDIYNEKSAGFAKFLKTNCCRFQEKDEEGNLLDSYFVVKRHTMSNYQHEETIYNLVKDCPAVAVHDFFKFRVDGDMVPHISRQRLTKYTMADLVYALRHFDEGNCDTLKEILVTYNCCDDDYFNKKDWYDFVENPDILRVYANLGERVRQSLLKTVQFCDAMRDAGIVGVLTLDNQDLNGNWYDFGDFVQVAPGCGVPIVDSYYSLLMPILTLTRALAAESHMDADLAKPLIKWDLLKYDFTEERLCLFDRYFKYWDQTYHPNCINCLDDRCILHCANFNVLFSTVFPPTSFGPLVRKIFVDGVPFVVSTGYHFRELGVVHNQDVNLHSSRLSFKELLVYAADPAMHAASGNLLLDKRTTCFSVAALTNNVAFQTVKPGNFNKDFYDFAVSKGFFKEGSSVELKHFFFAQDGNAAISDYDYYRYNLPTMCDIRQLLFVVEVVDKYFDCYDGGCINANQVIVNNLDKSAGFPFNKWGKARLYYDSMSYEDQDALFAYTKRNVIPTITQMNLKYAISAKNRARTVAGVSICSTMTNRQFHQKLLKSIAATRGATVVIGTSKFYGGWHNMLKTVYSDVETPHLMGWDYPKCDRAMPNMLRIMASLVLARKHNTCCNLSHRFYRLANECAQVLSEMVMCGGSLYVKPGGTSSGDATTAYANSVFNICQAVTANVNALLSTDGNKIADKYVRNLQHRLYECLYRNRDVDHEFVDEFYAYLRKHFSMMILSDDAVVCYNSNYAAQGLVASIKNFKAVLYYQNNVFMSEAKCWTETDLTKGPHEFCSQHTMLVKQGDDYVYLPYPDPSRILGAGCFVDDIVKTDGTLMIERFVSLAIDAYPLTKHPNQEYADVFHLYLQYIRKLHDELTGHMLDMYSVMLTNDNTSRYWEPEFYEAMYTPHTVLQAVGACVLCNSQTSLRCGACIRRPFLCCKCCYDHVISTSHKLVLSVNPYVCNAPGCDVTDVTQLYLGGMSYYCKSHKPPISFPLCANGQVFGLYKNTCVGSDNVTDFNAIATCDWTNAGDYILANTCTERLKLFAAETLKATEETFKLSYGIATVREVLSDRELHLSWEVGKPRPPLNRNYVFTGYRVTKNSKVQIGEYTFEKGDYGDAVVYRGTTTYKLNVGDYFVLTSHTVMPLSAPTLVPQEHYVRITGLYPTLNISDEFSSNVANYQKVGMQKYSTLQGPPGTGKSHFAIGLALYYPSARIVYTACSHAAVDALCEKALKYLPIDKCSRIIPARARVECFDKFKVNSTLEQYVFCTVNALPETTADIVVFDEISMATNYDLSVVNARLRAKHYVYIGDPAQLPAPRTLLTKGTLEPEYFNSVCRLMKTIGPDMFLGTCRRCPAEIVDTVSALVYDNKLKAHKDKSAQCFKMFYKGVITHDVSSAINRPQIGVVREFLTRNPAWRKAVFISPYNSQNAVASKILGLPTQTVDSSQGSEYDYVIFTQTTETAHSCNVNRFNVAITRAKIGILCIMSDRDLYDKLQFTSLEIPRRNVATLQAENVTGLFKDCSKIITGLHPTQAPTHLSVDIKFKTEGLCVDIPGIPKDMTYRRLISMMGFKMNYQVNGYPNMFITREEAIRHVRAWIGFDVEGCHATRDAVGTNLPLQLGFSTGVNLVAVPTGYVDTENNTEFTRVNAKPPPGDQFKHLIPLMYKGLPWNVVRIKIVQMLSDTLKGLSDRVVFVLWAHGFELTSMKYFVKIGPERTCCLCDKRATCFSTSSDTYACWNHSVGFDYVYNPFMIDVQQWGFTGNLQSNHDQHCQVHGNAHVASCDAIMTRCLAVHECFVKRVDWSVEYPIIGDELRVNSACRKVQHMVVKSALLADKFPVLHDIGNPKAIKCVPQAEVEWKFYDAQPCSDKAYKIEELFYSYATHHDKFTDGVCLFWNCNVDRYPANAIVCRFDTRVLSNLNLPGCDGGSLYVNKHAFHTPAFDKSAFTNLKQLPFFYYSDSPCESHGKQVVSDIDYVPLKSATCITRCNLGGAVCRHHANEYRQYLDAYNMMISAGFSLWIYKQFDTYNLWNTFTRLQSLENVAYNVVNKGHFDGHAGEAPVSIINNAVYTKVDGIDVEIFENKTTLPVNVAFELWAKRNIKPVPEIKILNNLGVDIAANTVIWDYKREAPAHVSTIGVCTMTDIAKKPTESACSSLTVLFDGRVEGQVDLFRNARNGVLITEGSVKGLTPSKGPAQASVNGVTLIGESVKTQFNYFKKVDGIIQQLPETYFTQSRDLEDFKPRSQMETDFLELAMDEFIQRYKLEGYAFEHIVYGDFSHGQLGGLHLMIGLAKRSQDSPLKLEDFIPMDSTVKNYFITDAQTGSSKCVCSVIDLLLDDFVEIIKSQDLSVISKVVKVTIDYAEISFMLWCKDGHVETFYPKLQASQAWQPGVAMPNLYKMQRMLLEKCDLQNYGENAVIPKGIMMNVAKYTQLCQYLNTLTLAVPYNMRVIHFGAGSDKGVAPGTAVLRQWLPTGTLLVDSDLNDFVSDADSTLIGDCATVHTANKWDLIISDMYDPRTKHVTKENDSKEGFFTYLCGFIKQKLALGGSIAVKITEHSWNADLYKLMGHFSWWTAFVTNVNASSSEAFLIGANYLGKPKEQIDGYTMHANYIFWRNTNPIQLSSYSLFDMSKFPLKLRGTAVMSLKENQINDMIYSLLEKGRLIIRENNRVVVSSDILVNN

SEQ ID NO: 1044 - protein, 1257 aa, Human severe acute respiratory syndrome virus
TNMFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 1045 - protein, 7 aa, Human severe acute respiratory syndrome virus
TNLWICL

SEQ ID NO: 1046 - protein, 12 aa, Human severe acute respiratory syndrome virus
DFLLLDQLLHSQ

SEQ ID NO: 1047 - protein, 43 aa, Human severe acute respiratory syndrome virus
KLTMLLLQVLFMLQQRYRYKPHSLSDGLLLALHFLLFFRALPK

SEQ ID NO: 1048 - protein, 8 aa, Human severe acute respiratory syndrome virus
LRSIKDGS

SEQ ID NO: 1049 - protein, 39 aa, Human severe acute respiratory syndrome virus
PFIRASSSFAIYCCYLLPSIHIFCLSLQVRRRNFCTSMP

SEQ ID NO: 1050 - protein, 13 aa, Human severe acute respiratory syndrome virus
YIFYNASTHVELL

SEQ ID NO: 1051 - protein, 169 aa, Human severe acute respiratory syndrome virus
DVGFVGSANPRTHYFMMPTTLFAGTHITMTTVYHITVSQIQLSLLKVTAFQHQNSKKTTKLVVILRIGTQVLKTMSLYMAISPKFTTSLSLHKLLQTLVLKMLHSSSLTSLLKTHRMCKYTQSTALQELLIQQWIQFMMSRRRLLACLCKHKKVSTNLCTHSFRKKQVR

SEQ ID NO: 1052 - protein, 14 aa, Human severe acute respiratory syndrome virus
LIAYFFFLLSWYSC

SEQ ID NO: 1053 - protein, 17 aa, Human severe acute respiratory syndrome virus
PSLLRFDCVRTAAILLT

SEQ ID NO: 1054 - protein, 12 aa, Human severe acute respiratory syndrome virus
NQRFTSTRVLKI

SEQ ID NO: 1055 - protein, 37 aa, Human severe acute respiratory syndrome virus
TLLKEFLIFWSKRTNYYYYSVWNFNIAYHGRQRYYYR

SEQ ID NO: 1056 - protein, 26 aa, Human severe acute respiratory syndrome virus
TTPGTMEPSNRFPIPSLDYVTTICLF

SEQ ID NO: 1057 - protein, 32 aa, Human severe acute respiratory syndrome virus
SEQVFVHNKACFPLALVASNTCLFCACCCLQN

SEQ ID NO: 1058 - protein, 19 aa, Human severe acute respiratory syndrome virus
LGDWRDCDCNGLYCRLDVA

SEQ ID NO: 1059 - protein, 42 aa, Human severe acute respiratory syndrome virus
LLRCFLQAVCSYPLNVVIQPRNKHSSQCASPGDNCDQTAHGK

SEQ ID NO: 1060 - protein, 22 aa, Human severe acute respiratory syndrome virus
TCHWCCDHSWSLANGRTLPRAL

SEQ ID NO: 1061 - protein, 27 aa, Human severe acute respiratory syndrome virus
GPAKRDHCGYITNAFLLQIRSVAACRH

SEQ ID NO: 1062 - protein, 14 aa, Human severe acute respiratory syndrome virus
FRFCCIQPLPYWKL

SEQ ID NO: 1063 - protein, 7 aa, Human severe acute respiratory syndrome virus
IKYRPRR

SEQ ID NO: 1064 - protein, 24 aa, Human severe acute respiratory syndrome virus
QRQYCFASTVSDNRCFILLTSRLQ

SEQ ID NO: 1065 - protein, 12 aa, Human severe acute respiratory syndrome virus
GLSGLLFGILTL

SEQ ID NO: 1066 - protein, 6 aa, Human severe acute respiratory syndrome virus
DNYLSL

SEQ ID NO: 1067 - protein, 7 aa, Human severe acute respiratory syndrome virus
LRRIIRS

SEQ ID NO: 1068 - protein, 7 aa, Human severe acute respiratory syndrome virus
MMKNLWS

SEQ ID NO: 1069 - protein, 128 aa, Human severe acute respiratory syndrome virus
IIHKTNMKIILFLTLIVFTSCELYHYQECVRGTTVLLKEPCPSGTYEGNSPFHPLADNKFALTCTSTHFAFACADGTRHTYQLRARSVSPKLFIRQEEVQQELYSPLFLIVAALVFLILCFTIKRKTE

SEQ ID NO: 1070 - protein, 4 aa, Human severe acute respiratory syndrome virus
MSSL

SEQ ID NO: 1071 - protein, 7 aa, Human severe acute respiratory syndrome virus
LTSICAF

SEQ ID NO: 1072 - protein, 7 aa, Human severe acute respiratory syndrome virus
PFCYSLF

SEQ ID NO: 1073 - protein, 13 aa, Human severe acute respiratory syndrome virus
CLLYFGFHSKSRI

SEQ ID NO: 1074 - protein, 10 aa, Human severe acute respiratory syndrome virus
KNLVPKSKRT

SEQ ID NO: 1075 - protein, 5 aa, Human severe acute respiratory syndrome virus
NFSLF

SEQ ID NO: 1076 - protein, 11 aa, Human severe acute respiratory syndrome virus
LVFLYAVAYAL

SEQ ID NO: 1077 - protein, 93 aa, Human severe acute respiratory syndrome virus
YSAVHLINLMCLKILVRYNTRGNTYSTAWLCALGKVLPFHRWHTMVQTCTPNVTINCQDPAGGALIARCWYLHEGHQTAAFRDVLVVLNKRTN

SEQ ID NO: 1078 - protein, 7 aa, Human severe acute respiratory syndrome virus
WTPIKPT

SEQ ID NO: 1079 - protein, 13 aa, Human severe acute respiratory syndrome virus
CPPHYIWWTHRFN

SEQ ID NO: 1080 - protein, 20 aa, Human severe acute respiratory syndrome virus
PEWRTQWGKAKTAPTPRFTQ

SEQ ID NO: 1081 - protein, 16 aa, Human severe acute respiratory syndrome virus
YCVLVHSSHSAWQGGT

SEQ ID NO: 1082 - protein, 12 aa, Human severe acute respiratory syndrome virus
IPSRPGRSNQHQ

SEQ ID NO: 1083 - protein, 15 aa, Human severe acute respiratory syndrome virus
PNWLLPKSYPTSSWW

SEQ ID NO: 1084 - protein, 27 aa, Human severe acute respiratory syndrome virus
RQNERAQPQMVLLLPRNWPRSFTSLRR

SEQ ID NO: 1085 - protein, 9 aa, Human severe acute respiratory syndrome virus
QRRHRMGCN

SEQ ID NO: 1086 - protein, 15 aa, Human severe acute respiratory syndrome virus
GSLEYTQRPHWHPQS

SEQ ID NO: 1087 - protein, 36 aa, Human severe acute respiratory syndrome virus
QCCHRATTSSRNNIAKRLLRRGKQRRQSSLFSLLIT

SEQ ID NO: 1088 - protein, 9 aa, Human severe acute respiratory syndrome virus
FKKFNSWQQ

SEQ ID NO: 1089 - protein, 8 aa, Human severe acute respiratory syndrome virus
GKFSCSNG

SEQ ID NO: 1090 - protein, 14 aa, Human severe acute respiratory syndrome virus
NCPRAIAARQIEPA

SEQ ID NO: 1091 - protein, 5 aa, Human severe acute respiratory syndrome virus
EQSFW

SEQ ID NO: 1092 - protein, 10 aa, Human severe acute respiratory syndrome virus
RPTTTRPNCH

SEQ ID NO: 1093 - protein, 4 aa, Human severe acute respiratory syndrome virus
EICC

SEQ ID NO: 1094 - protein, 40 aa, Human severe acute respiratory syndrome virus
KASPKTYCHKTVQRHSSIWETWSRTNPRKFRGPRPNQTRN

SEQ ID NO: 1095 - protein, 40 aa, Human severe acute respiratory syndrome virus
LQTLAANCTICSKCLCILWNVTHWHGSHTFGNMADLSWSH

SEQ ID NO: 1096 - protein, 16 aa, Human severe acute respiratory syndrome virus
QRSTIQRQRHTAEQAH

SEQ ID NO: 1097 - protein, 10 aa, Human severe acute respiratory syndrome virus
RIQNIPTNRA

SEQ ID NO: 1098 - protein, 7 aa, Human severe acute respiratory syndrome virus
KGQKEKD

SEQ ID NO: 1099 - protein, 20 aa, Human severe acute respiratory syndrome virus
SSAFAAETKEAAHCDSSSCG

SEQ ID NO: 1100 - protein, 14 aa, Human severe acute respiratory syndrome virus
FLQTTSKFHEWSFC

SEQ ID NO: 1101 - protein, 39 aa, Human severe acute respiratory syndrome virus
FNSGINTHDDHTRQMGYVNVFAIPFTIHSLLLCRMNSRN

SEQ ID NO: 1102 - protein, 12 aa, Human severe acute respiratory syndrome virus
TAQVGLVNFNLT

SEQ ID NO: 1103 - protein, 6 aa, Human severe acute respiratory syndrome virus
QSLINV

SEQ ID NO: 1104 - protein, 21 aa, Human severe acute respiratory syndrome virus
GGLERATTFSSRPRGVRSRVQ

SEQ ID NO: 1105 - protein, 12 aa, Human severe acute respiratory syndrome virus
IMLGRAAYMEEP

SEQ ID NO: 1106 - protein, 20 aa, Human severe acute respiratory syndrome virus
CVKLILVVLSPCDFNSFLGE

SEQ ID NO: 1107 - protein, 5 aa, Human severe acute respiratory syndrome virus
QKKKK

SEQ ID NO: 1108 - DNA, 29742 bp, Human severe acute respiratory syndrome virus
  CDS (1)..(29742)
tttttttttttttttgtcattctcctaagaagctattaaaatcacatggggatagcactactaaaattaattttacacattagggctcttccatataggcagctctccctagcattattcactgtaccctcgatcgtactccgcgtggcctcgatgaaaatgtggtggctctttcaagtcctccctaatgttacacattgattaaagattgctatgtgagattaaagttaactaaacctacttgtgctgtttagttacgagaattcattctgcacaagagtagactatgtatcgtaaacggaattgcgaaaacgtttacatagcccatctgccttgtgtggtcatcatgagtgtttatgcctgagttgaatcagcagaagctccactcatggaattttgaagttgtctggagaaatcatccatgtcagccgcaggaagaagagtcacagtgggctgcttcttttgtctctgcggcaaaggctgagcttcatcagtctttttctttttgtcctttttaggctctgttggtgggaatgttttgtatgcgtcaatgtgcttgttcagcagtatgacgttgtctttgaattgtggatctttgtcatccaatttaatggctccatgataagtcagccatgttcccgaaggtgtgacttccatgccaatgcgtgacattccaaagaatgcagaggcacttggagcaaattgtgcaatttgcggccaatgtttgtaatcagttccttgtctgattaggtcttggtccccgaaatttccttgggtttgttctggaccacgtctcccaaatgcttgagtgacgttgtactgttttgtggcagtacgtttttggcgaggctttttagatgcctcagcagcagatttcttagtgacagtttggccttgttgttgttggcctttaccagaaactttgctctcaagctggttcaatctgtctagcagcaatagcgcgagggcagtttcaccacctccgctagccattcgagcaggagaatttcccctactgctgccaggagttgaatttcttgaattaccgcgactacgtgatgaggagcgagaagaggcttgactgccgcctctgcttccctctgcgtagaagccttttggcaatgttgttccttgaggaagttgtagcacggtggcagcattgttattaggattgcgggtgccaatgtggtctttgggtgtattcaaggctccctcagttgcaacccatacgatgccttctttgttagcgccgtagggaagtgaagcttctgggccagttcctaggtaatagaagtaccatctggggctgagctctttcattttgccgtcaccaccacgaactcgtcgggtagctcttcggtagtagccaatttggtcatctggaccactattggtgttgattggaacgccctggcctcgagggaatctaagttcctccttgccatgctgagtgagagctgtgaaccaagacgcagtattattgggtaaaccttggggtcggcgctgttttggccttgccccattgcgtcctccattctggttattgtcagttgaatctgtgggtccaccaaatgtaatgcggggggcactacgttggtttgattggggtccattatcagacattttaatttgttcgtttatttaaaacaacaagtacgtctctaaatgcagcagtttggtgaccttcatgaaggtaccaacacctagctataagcgcaccaccagctggatcttgacagttgatagtaacattaggtgtgcatgtttgaaccatagtgtgccatctatgaaaaggtaaaacctttcctagagcacaaagccaagcagtgctataagtattacccctagtgttgtaccttacaaggatcttcaagcacatgaggtttattagatgcacagcgctgtactacagtgcatatgcaactgcatagagaaatacaagtcaaaacaatgagaagtttcatgttcgtttagactttggtacaaggttcttctagatcctggatttcgagtgaaaaccaaaatataataagcattattaaaacaaggaatagcagaaaggctaaaaagcacaaatagaagtcaattaaagtgagctcattcattctgtctttctcttaatggtgaagcaaagtattaaaaatactagagcagcaacaatgagaaaaagtggcgagtagagctcttgttgaacctcctcttgtctgatgaaaagttttggtgaaactgatcttgcacgcagctgataggtatgtcgagtaccgtcagcacaagcaaaagcaaagtgtgtgctagtgcaagttagtgcaaatttattgtcagcaagagggtgaaatggtgaattgccctcgtatgttcctgatgggcaaggttcttttagtagtacagtcgtacctctaacacactcctgatagtgatatagctcgcaagatgtaaatacaatcaatgtcaggaagagaataattttcatgttcgttttatggataatctaactccataggttcttcatcatctaactccgaataattcttcttagttagaggcttaaataattgtctcactattgaacttattataacgtcaagattccaaatagcaatcctgaaagtcctcataatgataatcaatatctctgctattgtaacctggaagtcaacaagatgaaacatctgttgtcacttactgtactagcaaagcaatattgtcgttgctaccggcgtggtctgtatttaatttatagtttccaatacggtagcggttgtatgcagcaaaacctgaatcagtgcctacacgctgcgacgctcctaatttgtaataagaaagcgttcgtgatgtagccacagtgatctcttttggcaggtccttaatgtcacagcgccctagggagtgtccggccattcgcaagtgaccacgaatgatcacagcaccaatgacaagttcactttccatgagcggtctggtcacaattgtcccccggagaggcacattgagaagaatgtttgtttctgggttgaatgaccacattgagcgggtacgagcaaacagcctgaaggaagcaacgaagtagctaagccacatcaagcctacaatacaagccattgcaatcgcaatcccgccagtcacccaattaattctgtagacaacagcaagcacaaaacaagcaagtgttactggccacaagagccagaggaaaacaagctttattatgtacaaaaacctgttccgattagaataggcaaattgtagtaacataatccaggctaggaataggaaacctattactaggttccattgttccaggagttgtttaagctcctcaacggtaatagtaccgttgtctgccatgataagcaatgttaaagttccaaacagaataataataatagttagttcgtttagaccagaagatcaggaactccttcagaagagttcagatttttaacacgcgagtagacgtaaaccgttggttttactaaactcacgttaacaatattgcagcagtacgcacacaatcgaagcgcagtaaggatggctagtgtgactagcaagaataccacgaaagcaagaaaaagaagtacgctattaactattaacgtacctgtttcttccgaaacgaatgagtacataagttcgtactcactttcttgtgcttacaaaggcacgctagtagtcgtcgtcggctcatcataaattggatccattgctggattagcaactcctgaagagccgtcgattgtgtgtatttgcacattcggtgggtctttaacaagcttgttaaagatgaagaatgtagcattttcaataccagtgtctgtagtaatttgtgtagactcaagctggtagtaaacttcggtgaaatagccatgtacaacgacatagtctttaacacctgagtgcctatcctcagaataaccaccaatttggtagtcttctttgagttttggtgttgaaatgccgtcaccttcagtaacgacaattgtatctgtgacactgttatatggtatacagtagtcatagttatgtgtgtgccagcaaacaaagtagttggcatcataaagtaatgggttcttggatttgcacttccaacaaagccaacatctcataataattctacatgcgttgatgcattgtagaaaatatatcaaggcatagaggtacaaaaattgcgcctccttacctgcagcgacaagcaaaagatgtgaatagatggtaacaaatagcagcagtaaattgcaaatgaactggaagcccttataaagggctagctgccatcttttattgagcgcaattattttggtagcgctctgaaaaacagcaagaaatgcaacgccaataacaagccatccgaaagggagtgaggcttgtagcggtatcgttgctgtagcatgaacagtacttgcaggagaagcattgtcaatttttactggctgtgcagtaattgatccaagagtaaaaaatctcataaacaaatccataagttcgtttatgtgtaatgtaatttgacacccttgagaactggctcagagtcatcctcatcaaacttgcagcaagaaccacaagagcatgcacccttgaggcaactgcaacaactagtcatgcaacaaagcaagattgtaaccatgacgatggcaattagtccagcaatgaagccgagccaaacataccaaggccatttaatatattgctcatattttcccaattcttgaaggtcaatgagtgattcatttaaatttttagcgacctcattgaggcggtcaatttctttttgaatgttgacgacagaagcgttaatgcctgaaatgtcgccaagatcaacatctggtgatgtatgatttttgaagtacttgtccagctcttctttgaatgagtcaagctcaggttgcagaggatcataaactgtgttgttaatgatgccaataacgacatcacaatttcctgagacaaatgtattgtctgtagtaattatttgtggagaaaagaagttcctctgtgtaataaaccaagaagtgccattaaacacaaaaacaccttcacgagggaagtatgctttgccttcatgacaaattgctggcgctgtggtgaagttcctctcctgggatggcacatacgtgacatgtaggaagacaacaccatgcggggctgcttgtgggaaggacataaggtggtagccctttccacaaaagtcaactctttttgattgtccaagaacacactcagacattttagtagcagcaagattagcagaagccctgatttcagcagccctgattagttgttgtgttacataggtttgaaggctttgaagtctgcctgtaattaacctgtcaatttgtacctccgcctcgactttatcaagtcgcgaaaggatatcatttagcacacttgaaattgcaccaaaattagagctaagttgtttaacaagtgtgtttaatgcttgagcattctggttaacaacgtcttgcagcttgcccaatgcagttgatgttgttgtaagtgattcttgaatttgactaatcgccttgttaaattggttggcgatttgtttttggttctcatagagaacattttgggtaactccaatgccattgaacctatatgccatttgcatagcaaaaggtatttgaagagcagcgccagcaccaaatgtccatccagcagtggcagtaccactaactagagcagcagtgtaggcagcaatcatatcatcagtgagcagaggtggcaacactgtaagtccattgaacttctgcgcacaaatgagatctctagcattaatatcacctaggcattcgccatattgcttcatgaagccagcatcagcgagtgtcaccttattaaagagcaagtcctcaataaaagacctcttagttggctttagagggtcaggtaatatttgtgaaaaattaaaaccaccaaaatatttcaaagttggggttttgtacatttgtttgacttgagcgaacacttcacgtgtgttgcgatcctgttcagcagcaatacctgagagtgcacgatttagttgtgtgcaaaagctaccatattggagaagcaaattagcacattcagtagaatctccgcagatgtacatattacaatctacggaggttttagccatagaaacaggcattacttctgtagtaatgctaattgaaaagttagtaggtatagcaatggtgttattagagtaagcaattgaactatcagcacctaaagacatagtataagccacaatagatttttggctagtactacgtaataaagaaactgtatggtaactagcacaaatgccagctccaataggaatgtcgcactcataagaagtgtcgacatgctcagctcctataagacagcctgcttgagtctggaatacattgtttccagtagaatatatgcgccaagctggtgtgagttgatctgcatgaattgctgtagaaacatcagtgcagttaacatcttgatatagaacagcaacttcagatgaagcatttgttccaggtgtaattacacttacacccccaaaagagcaaggtgaaatgtctaatatttcagatgttttaggatctcgaacggaatcagtgaaatcagaaacatcacggccaaattgttgaaatggttgaaatctctttgaagaaggagttaacacaccagtaccagtgagtccattaaaattaaaattgacacactggttcttaataaggtcagtggataattttggtccacaaaccgtggccggtgcatttaaaagttcaaaagaaagtactacaactctgtaaggttggtagccaatgccagtagtggtgtaaaaaccataatcatttaatggccaataacaattaagagcaggtggggtgcaaggtttgccatcaggggagaaaggcacattagatatgtctctctcaaagggcctaagcttgccatgtctaagatacctatatttataattataattaccagttgaagtagcatcaatgttcctagtattccaagcaaggacacaacccatgaaatcatctggcaatttataattataatcagcaataacaccagtttgtcctggcgctatttgtcttacatcatctcccttgactacaaaagaatctgcatagacattggagaagcaaagatcattcaacttagtggcagaaacgccatagcacttaaaggttgaaaaaaatgttgagttgtagagcacagagtaatcagcaacacaattagaaattttttttctctcccatgcatagacagaagggaatttagtagcattaaaaacctctccaaaaggacacaagtttgtaatattagggaatctcacaacatctcctgagggaacaaccctgaaattagaggtctggtaaattcctttgtcaatctcaaagctcttaacagagcatttgagttcagcaagtggattttgagaacaatcaacagcatctgtgattgtaccattttcatcatacttgagcataaatgtagttggctttaaatagccaacaaaataggctgcagctgacgtgccccaaatgtcttgagcaggtgaaaaggctgtaagaatggctctaaaatttgtaatgttaataccaagaggcaacttaaaaataggtttcaaagtgttaaaaccagaaggtagatcacgaactacatctataggttgatagcccttataaacatagagaaacccatctttatttttaaacacaaactctcgtaagtgtttaaaattacctgacttttctgaaacatcaagcgaaaaggcatcagatatgtactcgaaagtgcaattaaatgcattatcgaatatcatagtatgtgtctgtgtacccatgggtttagaaacagcaaagaaagggttgtcacacaattcaaagttacatgctcgtataacaacattagtagaattgttaataataatcaccgactgtgacttgttgttcatggtagaaccaaaaacccaaccacggacaacatttgatttctctgtggcagcaaaataaataccatccttaaaaggtatgacagggttgccaaacgtatgattaatagtatgaaaccctgtaacattagaataaaatggaagaaataaatcctgagttaaataaagagtgtctgatctaaaaatttcatcaggatagtaaacccccctcatagatgaagtatgttgagtgtaattaggagcttgaacatcatcaaaagtggtgcaccggtcaaggtcactaccactagtgagagtaagaaataataagaaaataaacatgttcgtttagttgttaacaagaatatcacttgaaaccacaactctgttgttttctctaatgataagcctacctttttccagaagagaataaatcatatcattgatttgattctccttaagagacattacagcagttcctcttaatttaagaggaaatttgctcatgtcaaagagtgaataggaagacaactggataggatttgtgttcctccagaaaatgtagttagcatgcatggtatagccatcaatttgttccttcggcttgccaagatagttagccccaattaaaaatgcttccgatgatgatgcatttacatttgtaacaaaagctgtccaccatgagaaatggcccataagcttgtaaaggtcagcattccaagaatgctctgttatctttacagctatagaaccacccagggctagtttttgctttataaatccacacagataagtgaaaaacccttctttagagtcattctcttttgtcacatgtttggtcctagggtcatacatatcgctaataataaggtcccatttattagccgtatgtactgttgcacagtctccaattaaagtagaatctgcgtcggagacgaagtcattaagatctgaatcgacaagtagtgtgccagttggcaaccattgtctgagcacagctgtacctggtgcaactcctttatcagagccagcaccaaagtgaataactctcatgttgtagggtacagctaaagtaagtgtatttaagtattgacacagttgagtatactttgcgacattcatcattattccttttggtataacagcattttcaccataattctgaaggtcacacttttcaagaagcattctttgcatcttgtacaagttaggcatcgcaacacctggttgccacgcttgacttgcttgtagttttgggtagaaggtttcaacatgtccatccttacaccaaagcatgaatgaaatttcagcatagtcaattgtaaccttgaccacttttgaaatcactgacaaatcttgtgactttattatctcgacaaagtcatcaagtaaaagatcaatcacagaacacacacattttgatgaacctgtttgcgcatctgttatgaagtaatttttcactgtgctgtccatagggataaaatcctctaatttaagtggtgaatcttgtgagcgcttggctaagcctatcattaaatgaagaccgccaagttgtccatgactgaaatctccataaacgatgtgttcgaaggcatagccctcgagcttatatcgctgtatgaattcatccatagcgagctcgagaaagtcagtttccatttgtgatctgggcttaaaatcctctaagtctctgctctgagtaaagtaggtttcaggcaactgttgaataatgccgtctactttcttaaagtagttaaactgtgtttttactgattctccaattaatgtgactccattgacgctagcttgtgctggtccctttgaaggtgttagacctttgactgaaccttctgttattaaaacaccattacgggcgtttctaaaaaggtctacctgtccttccactctaccatcaaacaagacagtaagtgaagaacaagcactctcagtaggtttcttggcaatgtcagtcattgtgcagacacctattgtagatacatgtgctggggcttctcttttgtagtcccagattacagtattagcagcgatatcaacacccaaattattgagtatcttaatctctggcactggtttaatgttacgcttagcccaaagctcaaatgcaacattaacaggaagtgttgtcttattttcaaagatctccacatcaataccatctacctttgtgtaaacagcattattaatgatggaaacaggtgcttcgccggcgtgtccatcaaagtgtcctttattaacaacattataagccacattttctaaactctgtaacctggtaaatgtattccacaggttataagtatcaaattgtttgtaaatccataggctaaatccagcagaaatcatcatattatatgcatccaagtactgtcggtactcatttgcatggtgtctgcaaacagcaccacctaaattgcatcgtgtaatacacgtagcagatttgagtggaacataatcaatatccgacactacttgtttgccatgagactcacaaggactatcagaatagtaaaagaaaggcaattgctttaaattagtaaatgcacttttatcgaaagctggagtgtggaatgcatgcttattcacatacaaactaccaccatcacagcctggtaagttcaagtttgacaagactcttgtgtcaaacctacacacaattgcattggctgggtaacgatcaacgttacaattccaaaacaaacaaacaccatcagtgaatttatcgtgatgtgtagcataagaatagaagagttcctctattttgtaagctttgtcactacatggctgagcatcgtagaacttccattctacttcagcctgaggcacacacttgatagcctttggatttccaatgtcatgaagaactggaaacttatcagcaagcaatgcagacttcacaaccatgtgttgtacttttctgcaagcagaattaaccctcagttcatctcctataatagggtattcaacagaccaatcaacgcgcttaacaaagcactcatggactgctaaacatctagtcatgatagcatcacaactagccacatgtgcatttccatgtacctggcaatgttggtcatggttactctgaaggttacccgtaaagccccactgctgaacatcaatcataaatgggttatagacatagtcaaaacccacagaatgattccagcaggcataagtatctgatgaagtagaaaagcaagttgcacgtttgtcacacagacaacacgttctttcaggtccaatcttgacaaagtacttcattgatgtaagctcaaagccatgcgcccaaaggacgaacacgactctgtctgacaatcctttcagtgtatcactgagcatttgtactatcttaatacgcactacattccagggcaagcctttatacatgagtggtataagatgtttaaactggtcacctggtggaggttttgcattaactctggtgaattctgtgttattttcagtgtcaacataaccagtcggtacagctactaagttaacacctgtagaaaatcctagctggagaggtaggttagtacccacagcatctctagttgcatgacagccctctacatcaaagccaatccacgcacgaacgtgacgaatagcttcttcgcgggtgataaacatattagggtaaccattgacttggtaattcattttgaaacccatcatagagatgagtctacggtaggtcatgtcctttggtatgcctggtatgtcaacacataatccttcagtcttgaattttatatcaacgctgaggtgtgtaggtgcctgtgtaggatgaagaccagtaatgatcttactacagtccttaaaaagtccagttacattttctgcttgtaatgtagccacattgcgacgtggtatttctagacttgtaaattgcagtttgtcataaagatctctatcagacattatgcacaaaatgccaatttttgcccttgtgatagccacattgaagcggttgacattacaagagtgtgctgtttcagtagtttgtgtgaatatgacatagtcatattcagaaccctgtgatgaatcaacagtctgcgtaggcaatcctaagatttttgaagctacagcgttctgtgaattataaggtgagataaaaacagcttttctccaagcaggattgcgtgtaagaaattctcttacaacgcctatttgaggtctgttgattgcagatgaaacatcatgtgtaataacacctttgtagaacattttgaagcattgagctgacttatccttgtgtgcttttagcttattgtcataaactaaagcactcacagtgtcaacaatttcagcaggacaacggcgacaagttccaaggaacatgtctggacctattgttttcataagtctgcacactgaattaaaatattctggttctagtgtgcctttagtcagcaatgtgcggggggctggtaattgagcaggatcgccaatatagacgtagtgttttgcacgaagtctagcattgacaacactcaagtcataattagtagccatagagatttcatcaaagactacaatgtcagcagttgtttctggcaatgcatttacagtgcagaaaacatactgttctagtgttgaattcactttgaatttatcaaaacactctacgcgcgcacgcgcaggtatgattctactacatttatctatgggcaaatattttaatgccttttcacatagggcatcaacagctgcatgagagcatgccgtatacactatgcgagcagatgggtaatagagagcaagtccgatggcaaaatgactcttaccagtaccaggtggtccttggagtgtagagtacttttgcatgccgaccttttgataatttgcaacattgctagaaaactcatctgagatgttgagtgttgggtacaagccagtaattctcacatagtgctcttgtggcactagagtaggtgcactaagtggcattacagtgtgagatgtcaacacaaagtaatcaccaacattcaacttgtatgtcgtagtacctctgtacacaacagcatcaccatagtcacctttttcaaaggtgtactctccaatctgtactttactatttttagttacacggtaaccagtaaagacatagtttctgttcaatggtggtctaggttttccaacctcccatgaaagatgcaattctctgtcagagagtacttcgcgtacagtggcaataccatatgacagcttaaatgtttcctcagtggctttgagcgtttctgctgcgaaaagcttgagtctctcagtacaagtgttggcaagtatgtaatcgccagcattagtccaatcacatgttgctatcgcattgaagtcagtgacattgtcactgcctacacatgtgtttttgtataaaccaaaaacctgaccattagcacataatggaaaactaatgggaggcttatgtgacttgcaataatagctcatacctcctagatacagttgtgtcacatcagtgacatcacaacctggggcattgcaaacatagggattaacagacaacactaatttgtgtgatgttgaaatgacatggtcatagcagcacttgcaacataggaatggtctcctaatacaggcaccgcaacgaagtgaagtctgtgaattgcacaatacacaagcacctacagcctgcaagactgtatgtggtgtgtacatagcctcataaaactcaggttcccagtaccgtgaggtgttatcattagttagcattacggaatacatgtccaacatgtggccagtaagctcatcatgtaactttctaatgtattgtaaatacaagtgaaagacatcagcatactcctgattaggatgttttgtaagtgggtaagcatcaatagccagtgacacgaacctttcaatcataagtgtaccatctgttttgacaatatcatcgacaaaacagcctgcgcctaatattcttgatggatctgggtaaggcaggtacacgtaatcatctccttgtttaactagcattgtatgctgtgagcaaaattcgtgaggtcctttagtaaggtcagtctcagtccaacattttgcctcagacatgaacacattattttgataataaagaactgccttaaagttcttaatgctagctactaaaccttgagccgcatagttactgttatagcacacaacggcatcatcagaaagaatcatcatggagaaatgtttacgcaggtaagcgtaaaactcatccacgaattcatgatcaacatccctatttctatagagacactcatagagcctgtgttgtagattgcggacatacttgtcagctatcttattaccatcagttgaaagaagtgcatttacattggctgtaacagcttgacaaatgttaaagacactattagcataagcagttgtagcatcaccggatgatgttccacctggtttaacatatagtgagccgccacacatgaccatctcacttaatacttgcgcacactcgttagctaacctgtagaaacggtgtgataagttacagcaagtgttatgtttgcgagcaagaacaagagaggccattatcctaagcatgttaggcatggctctgtcacattttggataatcccaacccataaggtgtggagtttctacatcactgtaaacagtttttaacatattatgccagccaccgtaaaacttgcttgttccaattaccacagtagctcctctagtggcggctattgacttcaataatttctgatgaaactgtctatttgtcatagtactacagatagagacaccagctacggtgcgagctctattctttgcactaatggcatacttaagattcatttgagttatagtagggatgacattacgcttagtatacgcgaaaagtgcatcttgatcctcataactcattgagtcataataaagtctagccttaccccatttattaaatgggaaaccagctgatttatccagattgttaacgattacttggttggcattaatacagccaccatcgtaacaatcaaagtatttatcaacaacttcaactacgaataggagttgtctgatatcacacattgttggcagattataacgataatagtcataatcactgatagcagcgttgccatcctgagcaaagaagaagtgttttagttcaacagaacttccttccttaaagaaacctttagacacagcaaagtcataaaagtctttattaaaattaccgggtttgacagtttgaaaagcaacattgtttgttagtgcagctactgaaaagcatgtagtgcgtttatctagcaataaattgccagaagctgcatgcatagctggatcagcagcatacactaaaagttccttgaaactgagacgcgagctatgtaagtttacatcctgattatgtacgactcctaactcacgaaaatggtatccagttgaaacaacaaaaggaacaccatctacaaatatttttcttactagtggtccaaaacttgtaggtggaaacacagtagaaaataacacattaaagtttgcacaatgaaggatacacctatcatccaaacagttaatacaattgggatggtatgtctggtcccaatatttaaaataacggtcgaagagacaaagtctctcttccgtaaaatcatatttcagcaaatcccacttaataagtggttttgcgagatcagcatccatatgggactcagcagccaatgccctagtcaaagtgaggatgggcatcagcaatgagtaatatgaatccacaataggaactccgcagcctggtgctacttgtacgaaatcaccgaaatcgtaccagttcccattaagatcctgattatctaatgtcagtacgcctacaatgcctgcatcacgcatagcatcgcagaattgtacagtctttaataatgattggcgtacacgctcacctaagttagcatatacgcgtaagatgtcaggattctctacgaagtcataccaatccttcttattgaaataatcatcatcacagcaattgtatgtgacgagtatttcttttaatgtatcacaattaccctcatcaaaatgacgtagagcatagactaaatcagccattgtgtatttagttagacgctgacgtgatatatgtggtaccatgtcaccatctactctaaacttgaaaaagtcatggacagcaaccgctggacaatctttaaccaagttataaatagtctcttcatgttggtagttagacatagtatgcctcttaactacaaagtaagagtctaataaattgccttcctcatccttctcctggaagcgacagcaattagtttttaggaactttgcaaaaccagcacttttttcgttgtaaatatcaaaagccctgtagacgacatcagtactagtgcctgtgccgcacggtgtaagacgggctgcacttacaccgcaaacccgtttaaaaacgttgatgcatccgcagactgcatcaagggttcgcggagttggtcacaactacagccataacctttccacattccgcagacggtacagactgtgtttctaagtgtaaaacccactgggtcattagcacaagtggtaggtatttggacgtacttacctttcaagtcacagaatcctttaggatttggatggtcaatgtggcatctacaatacagacaacatgaagcaccaccaaaggactcttggtccatgttagcttctggtgttacagtaattgcctgtcctgtaccagtgtgtgtacacaacatcttcacacagttggtgattggttgtcctccacttgctaggtaatccttatatgctttagcagggtctactgcaaaagcacagaaggaaagcacagttgaattggcaggtacttctgtagcatttccagcctgaagacgtactgtagcagctaaactgcccagcaccatacctctatttaggttgtttaagcctttgatgaagtacaagtatttcactttaggcccttttggtgtgtctgtaacaaacctacaaggtggttccagttctgtgtaaattgtacctgtaccatcactcttagggaatctagcccatttgagatcttggtggtctgatagtaatgccagcacaaacctacctcccttcgaattgttatagtaggcaagtgcattgtcatcagtacaagctgtttgtgtggtaccagccgcacaggacatctgtcgtagtgctactggactcagttcattattctgtagtttaacagctgagttggctcttagagctgtaacaataagaggccaagccaaatttggtgaattgtccatgttaatttcactaagttgaacaatcttgctatccgcatcaacaacttgctggatttcccagagtgcagatgcatatgtaaaggtgttaccatcacaagtgttcttgtaggtaccataatcagggacaacaaccatgagtttggctgctgtagtcaatggtatgatgttgagtggaacacaaccatcacgcgcattgttgataatgttgttaagtgcatcattatcaagcttcctaagcatagtgaagagcattgtttgcatagcactagttacttttgccctcttgtcctcagatcttgcctgtttgtacatttgggtcatagcctgatctgccatcttttccaacttgcgttgcatggcagcatcacggtcaaactcagatttagccacattcaaagatttctttaactttttgagaacgacttcagaatcaccattagctacagcctgctcataggcctcctgggcagtggcataagcggcatatgatggtaaagaactaaattctgaagcaatagcctgaagagtagcacggttatcgagcatttcctcgcacaacctattaatgtctacagcaccctgcatggatagcaaaacagacaaaagagaaaccatcttctcgaaagcttcagttgtgtcttttgcaagaagaatatcattgtggagttgtacacattgtgcccacaatttagaagatgactctactctaagttgttgaagaaccgagagcagtaccacagatgtgcactttacgtcagacattttagactgtacagtagcaaccttgatacatggtttacctccaatacccaacaacttaatgttaagcttgaaagcatcaatactactcttaggaggcaaaagcccctgggagttcatatacctaaattcttgtgtagagaccaagtagtcataaacaccaagagtaagcctgaagtaacggttgagtaaacagaaaaggccaaagtagcagcagcaacaatagcctaagaaacaataaacaagcatgatacactgtaaggtgttgccagtaataaataacaatgggtaatactcaacacacacaaacactatagctctagctaaaaacatgatagtcgtaacgacaccagaatagttagaggttacagaaataactaaggcccacatggaaatagcttgatctaaagcattaccatagtagactttgtaaacaagtgtaatgacattcatcagtgtccaaacacgtctagcagcatcatcataaacagtgcgagctgtcatgagaataagcaaaactaaagctgaagcatacataacacaatccttaagcctataaccagacaagctagtgtcagccaattcaagccatgtcatgatacgcatcacccagctagcaggcatgtagaccatattaaagtaagcaactgttgcaagagaaggtaacagaaacaagcacaagaatgcgtgcttatgcttaacaagcagcatagcacatgcagcaattgccataataccaagagtaaatggcaagaaagcattctcgtaaacaaagaaaaacagtgaccactgtgtactttgaacaagaatcaatagtgatgtcaagaaagttaaaagcatccaatgatgagtgcccttaacaattttcttgaacttaccttggaaggtaacaccagagcattgtctaacaacatcaaatggtgtaaactcatcttctaaaatagtgctaccaaggatagtacgaccattcataccattctgcagcagctctttcaaagcagcacacatatctaagacggcaattcctgtttgagcagaaagaggtcccaatatgtcaacatgatcttgtgtcaaaggttcatagttgtacttcattgccacaaggttaaagtcattcaaagtagtggtgaatctattaagaaaccacctatcaccattgataacagcagcatacagccatgccaaaacatttaatgttatggttgtgtctgtacctgcagcctgtgcagtttgtctgtcaacaaatggaccatagaatttaccttctaagtcagtaccagcgtgtactcctgttggaagctccatatgatgcatatagcagaaagacacgcaatcataatcaatgttaaaaccaacactaccacatgatccattaaggaaagaacctttaatggtatgattaggtctcatggcacactgataaacaccagatggtgaaccattgtagcatgctagaactgaaaatgtttgaccaggttggatacggacaaatttatacttgggtgtcttagggttagaagtatcaactttaagcctaagcagacaattttgcatagaatggccaataacacgaagttgaacattgccagcctgaacaagaaagctatggttggatttgcgaatgagcagatcttcatagttaggattaagcatgtcttctgctgtgcaaatgacatgtcttggacagtatactgtgtcatccaaccacaatccattaagagttgtagttccacaggttacttgtaccatgcacccttcaactttgcctgacgggaatgccattttcctaaaaccactctgcagaacagcagaagtgattgatgtctgtggtggttggtagagaacatcagcacctgagttgctaaagtcatttagagcctttgctaagtggcagcaagctgcttcacgatagctggtagtatctaaggctccactgaaatacttgtacttgttatatagagcaagatacctgttatactgtgtaagtggcaacagtgtctcgctacgcaattttaggtacatttccttgttgagcaaaaaggtacacaaagcagcctcctcgaaggtactaaatgtaactccattaaacatgactcttttcctaagatagttgttaaagaaccaatggcagtgcttcagagaaatacagaatacatagattgctgttatccaaaaaggcacaataggagaaaacatggcaaaccattgaaggtgagccaagaatgaaacatcattggtgaaatagaatgtcaagtacaagtaaaagactgagtagactcccggcagaaagctgtaagctggtaccagacagagtatagtgaaagacatcaaaaacaaaagtgcattagcagcaacaacatggttgtactcaccaaaaacacgtctgaatttcataaagtagtaggcagcacaagtcaccaatatggcaataataccaccagccactactgaagcagacacatctaaagcacccacaggttgcacaagaggagtaaagatgttagctatgagattcatcgcatcaacaccacagaaaactcctgatagagctctgtaatgctcattattaagaacccatctaccactggtagataggcaaatacctacttctgacctttcgcatgtaccatgtctacagtactcagcatcaaaagttgttactactctaacagaaccctccaggtaagtgttaggaaactgtatgatggaaccatccataagcacataacgagtgtctggacgaagctcactataagaaatagaaccctctagcaaattagtgtcataacaatatggcacaggtttgcccatagcatccttaaaaattgtacactcagcagcaagaacgcaagcagaggtagcaaaatcactatactcaatgagtttggaaggtgtgtagcaaatgttgccaacagcactaaaaacacgaggtagaaaatgcaagaagtcaccattgattgctctcagcacagtacccggtaagccaggcactatgaaaccaatctctcttgtaatgatagcagctactacagggcagcttttgtcatttttgtatgaaccaccacgctggctaaaccatgcgtcaaaaccagcatgtttatttgcaaaacaatcatcagtagaaatgatgtcacgagtgacaccatcctgaatggctttgtaaccaatgatttcatttgtgtaaccatcatggattgacaatgtatgtactggcataacgatataacaaaccaatgcagcaagaacgcacaataatgtggccttaagcataagtttaaaacaagtactaacaatcttaccacccttgagtgagattttagtagttatgacattgacaacctgtctagttgtagcacaagttagtgtaaaaggtatgttgttcttcttggcagcagtacgaatttgtttacgcagctgttcagataaagacatgtagtcttttacattccagatgagtgaaacattgtgactttttgctacttgggcattgatatgccttgcattacagtcaatacatgcgccaagatctctgggcgtcatgttttcaaccttattataggtgagcatgaaattgttacaactgtcacctgtcacttctaagtcagagtgatgtgaaagtttgagacattcaataacatcctttgtgtcaacatcggtatcaacaacaccttgtcgggcagctgacacgaatgtagaaaggacaccatctaaagctacaccctttgctaactcgctgtgagctgtagcaacaagtgccttaagtttttccataggaacactaaaagttgctgaaaaggtgtcgacataagcatcaaacatcttaacggaaacttcagtactatctccaacgtttgatacaagagcttggtcaagcaacagaataggttggcacatcagctgactgtagtacacagaagcagacttagaagcagactcgtcgcatttggacttgccatcaaaaactatgacattaataggcagtgaacctttagtgttgttagctctcaaattgtctaaattgacaaaatgggagagcggatgtctctcataggtcttttgaccagccttgtcaaagtagaggtgaagcgcgccatttttcacagcaacactatcaacaatatacgatgactggtcagtagggttgattggtcttttaaactggagtgacaaatcacgagcaacttcatcactaatgaatgtactaccagtgcaaaatgtgtcacaattgagacaattccaattgtgagtcttgcagaagccacggcctccatttgcatagacatagaaagatctcttcatgccattaacaatagttgtacactcaacgcgtgtggcacgattgcgcttatagcacatcatgcaagtcgaagaggtgcaaccatccatgatatgaacatagctcttccatatgtagtagaaagaagcaaagaagatgtacatcctaaccattgcagaaacgggtgccatttgtacaatactaatgataaaccacatgagccaagaattgctgatgaaatgactagcaaaatagccaaagaacacctgcattatagctgaaagacctaataaataaaagaattttgtgaacaacatatatgccaaaacccactcagcggccagacctaaaattgtcaagtctagcttgtacgatgaaatcgtcacctgaatggtttcaagagctggataagaatcaagggagtctaatccacttaaacaaatgctgcaaggaaaagaaccttcacagaaatccatagtagtaacgttagacgaattaagatacaattctctaacgccattacaataagaaggagcaccaaaattagataagagtacaccaaaagcagcagttacacagattagagaacctaagcaaatacttaacaacaatagccacatagcgattgtgaacaatttagaaaatttgggtgacttcacataattaatgccggcatccaaacataatttagcaacactcttaacactatttttagcaatagttgtaggtagtgaagctctaattctagaattggtacttttagtaaaagtacacaattggaacaataatgtaaacacataaggcatataattgttaaacacacgttgtgctaatctcttagcgcaatttgatgttgtaattgctgcttgtcctaagaatggtttgacataagccaaaattttactccaaggaacactattaattgcagcaataccatgagtggcaattgtttttaaacctaaggctagtgaaagctcattaggtttcttaatggtaatgcttgtgttttccacataagcagccataagatcctcatgacctaactcttgtgttactttaacaccttcatctgatggtttaagtatgacattgcctacaacttcggtagttttcacgtcacactctatgacttccttctgtatggtaggattttccactacttcttcagaggtgggttgttgactttcacaagcaagattgtccattccttgtgtgtcttctactgccagaacttcaaatgaatttgaagtatctactggctttgtactccaaagacaacgtaaacaccaagtgtttggtttgaacgttgtcttggttgtagcctggttaatgtgccaaacaattggcttatgcagtaatttagcacctttcttgaaactcgctgaatagtgtctatagtcaatagccactacatcgccattcaagtctgggaagaatgtgacagatagctctcgtgaagctggctttgtgaagcctgtcatttgatttaaatcatcagcaaattttgtgttagaacatgtgagtttgaaattatcaaaactcgcatttggtaatggttgagttggtacaaggtctataggctgctctgtatagtaagcattatcctttttataatacccatccaattttggttcaatctctgtgtaagtaactccatcgagtttatacgacacaggcttgatggttgtagtgtaagatgtttccttgtagaaaacatcagtcactggtcctttgtactctgacatctttgtaaggtgagctccgtcaatacgatagagggtctccttagcagttatatgagtgtaatgaccacactgatagttaccagtgtactcattcgcacataagaatgtaccttgctgtaatttatactcagcaggtggtgcagacatcataacaaaagaagactcttgttgtactagatattgtgtagcatcacgaccacacacacatggaatggaaacacctgtcttaagattatcataagatagagtacccatatacatcacagcttctacacccgttaaggtagtagttttctgaccacaatgtttacacaccacattaagaactcgctttgcagattccaaattagcatgctgtagaagatgggtcatagtttctctgacatcaccaagctcgccaacagttttattactgtaagcgagtatgagtgcacaaaagttagcagcatcaccagcacgggctctataataagcctcttgaagtgctggtgcattgaatttgacttcaagctgttgaagtgctaataaaacactagacaaataacaattgttatcagcccatttaattgaagttaaaccaccaacttgaggaaatttccatttctttgtgtggtttaaagcagacatgtacctaccaagaaaactctcatcaagagtatggtagtactcgaaagcttcactacgtagtgtgtcatcactaggtagtacaaagaaagtcttaccctcatgatttacatgaggtttaatttttgtaacatcagcaccatccaagtatgttggaccaaactgctgtccatatgtcatagacatatccacaagctgtgtgtggagattagtgttgtccacagttgtgaacacttttatagtcttaacctcccgcagggataagagactctttagtttgtcaagtgaaagaacctcaccgtcaagatgaaactcgacggggctctccagagtgtggtacacaattttgtcaccacgcttaagaaattcaacacctaactctgtacgctgtcctgaataggaccaatctctgtaagagccagccaaagaaactgtttctacaaagtgctcctcagatgtctttgatgacgaagtgaggtatccattatatgtagtaacagcatctggtgatgatactgacactacggcaggagctttaagagaacgcatacagcgcgcagcctcttcaagattaaaaccatgtgtcacataaccaattggcattgtgacaagcggctcatttagagagttcagcttcgtaataatagaagctacaggctctttactagtataaaagaagaatcggacaccatagtcaacgatgccctcttgaattttaattcctttatacttacgttggatggttgccattatggctctaacatccatgcatataggcattaattttcttgtctcttcagcatgagcaagcatttctctcaaattccaggatacagttcctagaatctcttccttagcattaggtgcttctgaaggtagtacataaaatgcagatttgcatttcttaagagcagtcttagcttcctcaagtgtataaccagcacatccttgtccagggtacgtggttatatactcatcaactggcactttcttcaaagctcttgagagcatctcagtagtgccaccagcctttttggagggtattacaacacaagtgatatcaccactagtgataacatcacctaccatgtaaggtgcatccttctcaaggaaagacatatcttcacctctaagcatgttctgagaatcatggtaaagcttaccattgatatcagcaaacaagagtaacttattggtaagaaacttagtttcttccagtgttgtggtaacctcatcaatgcaggccttaatttttggcttcacatcgacaggcttctgtacgacagatttctcctcagttttggaatcttctgtgtttggtggctcctcttgtttaggtgcttccactctaggcttcaggttatcaagataatccatgacaacctgctcataaagagctttgtcattgactgcaatataaacctgtgtacgaaccgtctgcacgcacacttgtaaagactgaagtggtttagcaccaaatatgcctgctgacaacaatggtgcaagtaagatgtcctgtgaattgaaattttcatatgctgccttaagaagctggatgtcctcacctgcatttaggttaggtccaacaacatgcagacacttcttagcaagattatgtccagaaagcaaacaagaccctcctactgtaagagggccatttagcttaatgtaatcatcactctccttttgcatggcaccattggttgccttgttgagtgcacctgctacaccaccaccatgtttcaggtgtatgttagcagcatttacaatcaccataggattagcactttgtgcctccttaacgatgtcaacacatttaatggcaacattgtcagtaagttttaaataaccagtaaactgattaactggttcttcaggtgtaggttctggttctggctcaatctctgattgctcagtagtatcatccagccagtcttcctcttcttcttcctcaactcgaactgtttcagctgaggcaccaaattccagagggagaccttgataatcatcctctgtaccgtactcatgttcacaggtttcatcaatttcttcttcctcacactctgcatcgtcctcttcttcctcatctggagggtaaaaggaacaatacatacgtgatgaaaagttttcttcaccagcatcatcaaataagtagaatgtagctacactccactcatcaagatcaatacccatgttggtaaggagatcagaaactggttgtaaagtcttcacaacagcctctgctacaacacatgcaaactcagtaacttcggtaccggattcaacagtgtagacagagcacttttcattaagcactttgtcaacacgttcatcaagctcaaatgtgattctcacattcttgtaaccttgaacttcccaaacagtatcttctccaaaggttacacctttaattggtgcacccccttttaagcgaaagacattgtttgtagccagtaaaccaggagacaatgcgcagtattgttctttgtccttaatctctaagagcatgaggccatttacacagactggtgtgccgacgatagctccatttgtgaagctatcaacgggcgtctcgagtgcttcgagttcaccgttcttgagaacaacctcctcagaggtaagtactgtgtcatgtgaatcaccttcaagaaaggttacttcttttggtgccttaagaggcatgagtagttgcagctgctccttgccacgtatacactgacggtaaagtcccttgctttgagcgatgaagacttcacctaagttgagtgatcgcaactttgcgccagcgatagtgacttgatcaatgcacatttcgagtgccttgttaacaacatcaatgaagcattttacacaatccttgatgttatctgaagcaacctgtatttgacccttgacgatgtcaaaaacacctgtaatgagaaatttgagaatctcccaagcatccttgagaaattcaactcctgcactaagtttcgcctcaatccattcaaagataggcctgagtttttcaacagtagtgcccaaaagattagacaaccactgagaagtctgttgtacaagaccaccagttacatatgccataataatgacactgttggtgagcaggtctgaagtataaaccatggcgtcgacaagacgtaatgactgttcagaaataccatcaagtatggtgacagctgctctttgcaaatcaggaattgagtggtttgctgcatcaagtgtgcgcgcaaaaattgatctgataacaccagcagcctgtgagggaaaaccacacagtggtgttaaaactgatctctgttgtccaatgttccaagcaccttttacgggctttcccttggtaactttatagttaccgcaggactcaacaatggttttgaaagacttgtaatcaagactctttatagtgtcaataaaggcacttgtagaagcagagaaagatgccaaaatgatggcaacctcttcattcaaatgaaaatcgccaacaatgttaatgttaacacgttcacgactcagtatctcaaggagatcctcattcaaggtctccacattgtcaccagtaatgccagtatggcctgagccaatatcagcactagcacgaggaacccagtaggcacgcttattatagcagccaacataggcaaacacacagcctccaaaacatctagtcctacctcccttgcggagtcgagtttcaatgtttgagtggttgtgataatctgcaacactatgctcaggtccaatctctgggtcttgacaggcaggacatggcattttcactacagcattagtaggtaggtacccacatgtagtaggtccttcaataactaaattttcagtgccacaatgttcacaagtggctttcagaaagtcgcacgtctgccatgaaacttcatcgcaatgattacatttcatcaaggtagacaagtgcatattgttacactcctgtggagatgcaacagggtacacagagcgtatacgccccatgaaaccctcagtctttttcttttcaacacgtggttgaatgactttgacttttgagttaagaggaaacacaaactttgggcattcccctttgaaagtgtcaaatttcttggcactcttaatttcgaagggtgtctggtgctcgtagctcttatcagagcgctcagtgaaccaggcaatttcatgctcatggtcacggcagcagtagacacctctcttcgactcgatgtaatcaagttgttcggaaagagtgcacattgacttgcccgcgcgtgcgagaaaatctttgatgcaatcaagagggtacccatctgggccacagaaattgttgtcgacatagcgagtgactgcacctccattgagctcacgagtgagttcacggagtgcaccactgccatgcttagtgttccagttttgttcataatcttcaatgggatcagtgccaagctcgtcacctaagtcataagactttagatcgatgccatagctatgaccaccggctcccttattaccgttcttacgaagaagaacattgcggtatgcaattggggtttcgcccacatgtggcacgagtactcccagtgttataccgctacgaccgtactgaatgccgtccatttctgcaaccagctcaacgaccttgtggccgtgattggtgcttaaggcatcagaacgtttaatgaacacatagggctgttcaagctggggcagtacgcctttttccagctctactagaccacaagtgccatttttgaggtgttcacgtgcctccgatagggcctcttccacagagtccccgaagccacgcactagcacgtctctaacctgaaggacaggcaaactgagttggacgtgtgttttctcgttgacaccaagaacaaggctctccatcttacctttcggtcacacccggacgaaacctaggtatgctgatgatcgactgcaacacggacgaaaccgtaagcagtctgcagaagagggacgagttactcgtttcttgtcaacgacagtaaaatttattattgtttatactgcgtaggtgcactaggcatgcagccgagcgacagctacacagattttaaagttcgtttagagaacagatctacaagagatcgaggttggttggcttttcctgggtaggtaaaaacctaatat

SEQ ID NO: 1109 - protein, 12 aa, Human severe acute respiratory syndrome virus
FFFFFVILLRSY

SEQ ID NO: 1110 - protein, 53 aa, Human severe acute respiratory syndrome virus
NHMGIALLKLILHIRALPYRQLSLALFTVPSIVLRVASMKMWWLFQVLPNVTH

SEQ ID NO: 1111 - protein, 5 aa, Human severe acute respiratory syndrome virus
LKIAM

SEQ ID NO: 1112 - protein, 21 aa, Human severe acute respiratory syndrome virus
LNLLVLFSYENSFCTRVDYVS

SEQ ID NO: 1113 - protein, 23 aa, Human severe acute respiratory syndrome virus
TELRKRLHSPSALCGHHECLCLS

SEQ ID NO: 1114 - protein, 99 aa, Human severe acute respiratory syndrome virus
ISRSSTHGILKLSGEIIHVSRRKKSHSGLLLLSLRQRLSFISLFLFVLFRLCWWECFVCVNVLVQQYDVVFELWIFVIQFNGSMISQPCSRRCDFHANA

SEQ ID NO: 1115 - protein, 26 aa, Human severe acute respiratory syndrome virus
HSKECRGTWSKLCNLRPMFVISSLSD

SEQ ID NO: 1116 - protein, 66 aa, Human severe acute respiratory syndrome virus
VLVPEISLGLFWTTSPKCLSDVVLFCGSTFLARLFRCLSSRFLSDSLALLLLAFTRNFALKLVQSV

SEQ ID NO: 1117 - protein, 23 aa, Human severe acute respiratory syndrome virus
REGSFTTSASHSSRRISPTAARS

SEQ ID NO: 1118 - protein, 5 aa, Human severe acute respiratory syndrome virus
ITATT

SEQ ID NO: 1119 - protein, 27 aa, Human severe acute respiratory syndrome virus
GARRGLTAASASLCVEAFWQCCSLRKL

SEQ ID NO: 1120 - protein, 38 aa, Human severe acute respiratory syndrome virus
HGGSIVIRIAGANVVFGCIQGSLSCNPYDAFFVSAVGK

SEQ ID NO: 1121 - protein, 6 aa, Human severe acute respiratory syndrome virus
SFWASS

SEQ ID NO: 1122 - protein, 67 aa, Human severe acute respiratory syndrome virus
VIEVPSGAELFHFAVTTTNSSGSSSVVANLVIWTTIGVDWNALASRESKFLLAMLSESCEPRRSIIG

SEQ ID NO: 1123 - protein, 21 aa, Human severe acute respiratory syndrome virus
TLGSALFWPCPIASSILVIVS

SEQ ID NO: 1124 - protein, 15 aa, Human severe acute respiratory syndrome virus
ICGSTKCNAGGTTLV

SEQ ID NO: 1125 - protein, 20 aa, Human severe acute respiratory syndrome virus
LGSIIRHFNLFVYLKQQVRL

SEQ ID NO: 1126 - protein, 13 aa, Human severe acute respiratory syndrome virus
MQQFGDLHEGTNT

SEQ ID NO: 1127 - protein, 9 aa, Human severe acute respiratory syndrome virus
AHHQLDLDS

SEQ ID NO: 1128 - protein, 6 aa, Human severe acute respiratory syndrome virus
VCMFEP

SEQ ID NO: 1129 - protein, 23 aa, Human severe acute respiratory syndrome virus
CAIYEKVKPFLEHKAKQCYKYYP

SEQ ID NO: 1130 - protein, 10 aa, Human severe acute respiratory syndrome virus
CCTLQGSSST

SEQ ID NO: 1131 - protein, 30 aa, Human severe acute respiratory syndrome virus
GLLDAQRCTTVHMQLHREIQVKTMRSFMFV

SEQ ID NO: 1132 - protein, 34 aa, Human severe acute respiratory syndrome virus
TLVQGSSRSWISSENQNIISIIKTRNSRKAKKHK

SEQ ID NO: 1133 - protein, 13 aa, Human severe acute respiratory syndrome virus
KSIKVSSFILSFS

SEQ ID NO: 1134 - protein, 11 aa, Human severe acute respiratory syndrome virus
SKVLKILEQQQ

SEQ ID NO: 1135 - protein, 14 aa, Human severe acute respiratory syndrome virus
EKVASRALVEPPLV

SEQ ID NO: 1136 - protein, 27 aa, Human severe acute respiratory syndrome virus
KVLVKLILHAADRYVEYRQHKQKQSVC

SEQ ID NO: 1137 - protein, 34 aa, Human severe acute respiratory syndrome virus
CKLVQIYCQQEGEMVNCPRMFLMGKVLLVVQSYL

SEQ ID NO: 1138 - protein, 11 aa, Human severe acute respiratory syndrome virus
HTPDSDIARKM

SEQ ID NO: 1139 - protein, 8 aa, Human severe acute respiratory syndrome virus
IQSMSGRE

SEQ ID NO: 1140 - protein, 7 aa, Human severe acute respiratory syndrome virus
FSCSFYG

SEQ ID NO: 1141 - protein, 12 aa, Human severe acute respiratory syndrome virus
SNSIGSSSSNSE

SEQ ID NO: 1142 - protein, 45 aa, Human severe acute respiratory syndrome virus
FFLVRGLNNCLTIELIITSRFQIAILKVLIMIINISAIVTWKSTR

SEQ ID NO: 1143 - protein, 8 aa, Human severe acute respiratory syndrome virus
NICCHLLY

SEQ ID NO: 1144 - protein, 13 aa, Human severe acute respiratory syndrome virus
QSNIVVATGVVCI

SEQ ID NO: 1145 - protein, 14 aa, Human severe acute respiratory syndrome virus
FIVSNTVAVVCSKT

SEQ ID NO: 1146 - protein, 9 aa, Human severe acute respiratory syndrome virus
ISAYTLRRS

SEQ ID NO: 1147 - protein, 7 aa, Human severe acute respiratory syndrome virus
FVIRKRS

SEQ ID NO: 1148 - protein, 16 aa, Human severe acute respiratory syndrome virus
CSHSDLFWQVLNVTAP

SEQ ID NO: 1149 - protein, 44 aa, Human severe acute respiratory syndrome virus
GVSGHSQVTTNDHSTNDKFTFHERSGHNCPPERHIEKNVCFWVE

SEQ ID NO: 1150 - protein, 72 aa, Human severe acute respiratory syndrome virus
AGTSKQPEGSNEVAKPHQAYNTSHCNRNPASHPINSVDNSKHKTSKCYWPQEPEENKLYYVQKPVPIRIGKL

SEQ ID NO: 1151 - protein, 4 aa, Human severe acute respiratory syndrome virus
HNPG

SEQ ID NO: 1152 - protein, 4 aa, Human severe acute respiratory syndrome virus
ETYY

SEQ ID NO: 1153 - protein, 24 aa, Human severe acute respiratory syndrome virus
VPLFQELFKLLNGNSTVVCHDKQC

SEQ ID NO: 1154 - protein, 9 aa, Human severe acute respiratory syndrome virus
SSKQNNNNS

SEQ ID NO: 1155 - protein, 17 aa, Human severe acute respiratory syndrome virus
TRRSGTPSEEFRFLTRE

SEQ ID NO: 1156 - protein, 76 aa, Human severe acute respiratory syndrome virus
TVGFTKLTLTILQQYAHNRSAVRMASVTSKNTTKARKRSTLLTINVPVSSETNEYISSYSLSCAYKGTLVVVVGSS

SEQ ID NO: 1157 - protein, 50 aa, Human severe acute respiratory syndrome virus
IGSIAGLATPEEPSIVCICTFGGSLTSLLKMKNVAFSIPVSVVICVDSSW

SEQ ID NO: 1158 - protein, 4 aa, Human severe acute respiratory syndrome virus
TSVK

SEQ ID NO: 1159 - protein, 5 aa, Human severe acute respiratory syndrome virus
PCTTT

SEQ ID NO: 1160 - protein, 10 aa, Human severe acute respiratory syndrome virus
SLTPECLSSE

SEQ ID NO: 1161 - protein, 4 aa, Human severe acute respiratory syndrome virus
PPIW

SEQ ID NO: 1162 - protein, 27 aa, Human severe acute respiratory syndrome virus
SSLSFGVEMPSPSVTTIVSVTLLYGIQ

SEQ ID NO: 1163 - protein, 8 aa, Human severe acute respiratory syndrome virus
LCVCQQTK

SEQ ID NO: 1164 - protein, 31 aa, Human severe acute respiratory syndrome virus
SNGFLDLHFQQSQHLIIILHALMHCRKYIKA

SEQ ID NO: 1165 - protein, 17 aa, Human severe acute respiratory syndrome virus
RYKNCASLPAATSKRCE

SEQ ID NO: 1166 - protein, 16 aa, Human severe acute respiratory syndrome virus
MVTNSSSKLQMNWKPL

SEQ ID NO: 1167 - protein, 16 aa, Human severe acute respiratory syndrome virus
RASCHLLLSAIILVAL

SEQ ID NO: 1168 - protein, 26 aa, Human severe acute respiratory syndrome virus
KTARNATPITSHPKGSEACSGIVAVA

SEQ ID NO: 1169 - protein, 37 aa, Human severe acute respiratory syndrome virus
TVLAGEALSIFTGCAVIDPRVKNLINKSISSFMCNVI

SEQ ID NO: 1170 - protein, 20 aa, Human severe acute respiratory syndrome virus
ELAQSHPHQTCSKNHKSMHP

SEQ ID NO: 1171 - protein, 5 aa, Human severe acute respiratory syndrome virus
GNCNN

SEQ ID NO: 1172 - protein, 7 aa, Human severe acute respiratory syndrome virus
SCNKARL

SEQ ID NO: 1173 - protein, 7 aa, Human severe acute respiratory syndrome virus
RWQLVQQ

SEQ ID NO: 1174 - protein, 9 aa, Human severe acute respiratory syndrome virus
SRAKHTKAI

SEQ ID NO: 1175 - protein, 12 aa, Human severe acute respiratory syndrome virus
YIAHIFPILEGQ

SEQ ID NO: 1176 - protein, 6 aa, Human severe acute respiratory syndrome virus
VIHLNF

SEQ ID NO: 1177 - protein, 8 aa, Human severe acute respiratory syndrome virus
GGQFLFEC

SEQ ID NO: 1178 - protein, 4 aa, Human severe acute respiratory syndrome virus
RQKR

SEQ ID NO: 1179 - protein, 15 aa, Human severe acute respiratory syndrome virus
CLKCRQDQHLVMYDF

SEQ ID NO: 1180 - protein, 7 aa, Human severe acute respiratory syndrome virus
STCPALL

SEQ ID NO: 1181 - protein, 14 aa, Human severe acute respiratory syndrome virus
MSQAQVAEDHKLCC

SEQ ID NO: 1182 - protein, 12 aa, Human severe acute respiratory syndrome virus
RHHNFLRQMYCL

SEQ ID NO: 1183 - protein, 10 aa, Human severe acute respiratory syndrome virus
LFVEKRSSSV

SEQ ID NO: 1184 - protein, 5 aa, Human severe acute respiratory syndrome virus
TKKCH

SEQ ID NO: 1185 - protein, 21 aa, Human severe acute respiratory syndrome virus
TQKHLHEGSMLCLHDKLLALW

SEQ ID NO: 1186 - protein, 9 aa, Human severe acute respiratory syndrome virus
SSSPGMAHT

SEQ ID NO: 1187 - protein, 15 aa, Human severe acute respiratory syndrome virus
HVGRQHHAGLLVGRT

SEQ ID NO: 1188 - protein, 21 aa, Human severe acute respiratory syndrome virus
GGSPFHKSQLFLIVQEHTQTF

SEQ ID NO: 1189 - protein, 4 aa, Human severe acute respiratory syndrome virus
FQQP

SEQ ID NO: 1190 - protein, 15 aa, Human severe acute respiratory syndrome virus
LVVVLHRFEGFEVCL

SEQ ID NO: 1191 - protein, 28 aa, Human severe acute respiratory syndrome virus
LTCQFVPPPRLYQVAKGYHLAHLKLHQN

SEQ ID NO: 1192 - protein, 10 aa, Human severe acute respiratory syndrome virus
QVCLMLEHSG

SEQ ID NO: 1193 - protein, 13 aa, Human severe acute respiratory syndrome virus
QRLAACPMQLMLL

SEQ ID NO: 1194 - protein, 6 aa, Human severe acute respiratory syndrome virus
VILEFD

SEQ ID NO: 1195 - protein, 15 aa, Human severe acute respiratory syndrome virus
IGWRFVFGSHREHFG

SEQ ID NO: 1196 - protein, 4 aa, Human severe acute respiratory syndrome virus
LQCH

SEQ ID NO: 1197 - protein, 6 aa, Human severe acute respiratory syndrome virus
TYMPFA

SEQ ID NO: 1198 - protein, 20 aa, Human severe acute respiratory syndrome virus
QKVFEEQRQHQMSIQQWQYH

SEQ ID NO: 1199 - protein, 12 aa, Human severe acute respiratory syndrome virus
LEQQCRQQSYHQ

SEQ ID NO: 1200 - protein, 6 aa, Human severe acute respiratory syndrome virus
AEVATL

SEQ ID NO: 1201 - protein, 5 aa, Human severe acute respiratory syndrome virus
TSAHK

SEQ ID NO: 1202 - protein, 10 aa, Human severe acute respiratory syndrome virus
YHLGIRHIAS

SEQ ID NO: 1203 - protein, 9 aa, Human severe acute respiratory syndrome virus
SQHQRVSPY

SEQ ID NO: 1204 - protein, 5 aa, Human severe acute respiratory syndrome virus
RASPQ

SEQ ID NO: 1205 - protein, 12 aa, Human severe acute respiratory syndrome virus
LALEGQVIFVKN

SEQ ID NO: 1206 - protein, 14 aa, Human severe acute respiratory syndrome virus
NHQNISKLGFCTFV

SEQ ID NO: 1207 - protein, 34 aa, Human severe acute respiratory syndrome virus
LERTLHVCCDPVQQQYLRVHDLVVCKSYHIGEAN

SEQ ID NO: 1208 - protein, 13 aa, Human severe acute respiratory syndrome virus
NLRRCTYYNLRRF

SEQ ID NO: 1209 - protein, 6 aa, Human severe acute respiratory syndrome virus
KQALLL

SEQ ID NO: 1210 - protein, 4 aa, Human severe acute respiratory syndrome virus
QWCY

SEQ ID NO: 1211 - protein, 11 aa, Human severe acute respiratory syndrome virus
SKQLNYQHLKT

SEQ ID NO: 1212 - protein, 4 aa, Human severe acute respiratory syndrome virus
YKPQ

SEQ ID NO: 1213 - protein, 10 aa, Human severe acute respiratory syndrome virus
YYVIKKLYGN

SEQ ID NO: 1214 - protein, 6 aa, Human severe acute respiratory syndrome virus
HKCQLQ

SEQ ID NO: 1215 - protein, 14 aa, Human severe acute respiratory syndrome virus
ECRTHKKCRHAQLL

SEQ ID NO: 1216 - protein, 12 aa, Human severe acute respiratory syndrome virus
DSLLESGIHCFQ

SEQ ID NO: 1217 - protein, 7 aa, Human severe acute respiratory syndrome virus
NICAKLV

SEQ ID NO: 1218 - protein, 7 aa, Human severe acute respiratory syndrome virus
VDLHELL

SEQ ID NO: 1219 - protein, 5 aa, Human severe acute respiratory syndrome virus
KHQCS

SEQ ID NO: 1220 - protein, 16 aa, Human severe acute respiratory syndrome virus
HLDIEQQLQMKHLFQV

SEQ ID NO: 1221 - protein, 18 aa, Human severe acute respiratory syndrome virus
LHLHPQKSKVKCLIFQMF

SEQ ID NO: 1222 - protein, 6 aa, Human severe acute respiratory syndrome virus
DLERNQ

SEQ ID NO: 1223 - protein, 25 aa, Human severe acute respiratory syndrome virus
NQKHHGQIVEMVEISLKKELTHQYQ

SEQ ID NO: 1224 - protein, 4 aa, Human severe acute respiratory syndrome virus
HTGS

SEQ ID NO: 1225 - protein, 32 aa, Human severe acute respiratory syndrome virus
GQWIILVHKPWPVHLKVQKKVLQLCKVGSQCQ

SEQ ID NO: 1226 - protein, 13 aa, Human severe acute respiratory syndrome virus
WCKNHNHLMANNN

SEQ ID NO: 1227 - protein, 15 aa, Human severe acute respiratory syndrome virus
EQVGCKVCHQGRKAH

SEQ ID NO: 1228 - protein, 7 aa, Human severe acute respiratory syndrome virus
ICLSQRA

SEQ ID NO: 1229 - protein, 4 aa, Human severe acute respiratory syndrome virus
ACHV

SEQ ID NO: 1230 - protein, 12 aa, Human severe acute respiratory syndrome virus
DTYIYNYNYQLK

SEQ ID NO: 1231 - protein, 4 aa, Human severe acute respiratory syndrome virus
HQCS

SEQ ID NO: 1232 - protein, 8 aa, Human severe acute respiratory syndrome virus
YSKQGHNP

SEQ ID NO: 1233 - protein, 11 aa, Human severe acute respiratory syndrome virus
NHLAIYNYNQQ

SEQ ID NO: 1234 - protein, 14 aa, Human severe acute respiratory syndrome virus
HQFVLALFVLHHLP

SEQ ID NO: 1235 - protein, 16 aa, Human severe acute respiratory syndrome virus
LQKNLHRHWRSKDHST

SEQ ID NO: 1236 - protein, 7 aa, Human severe acute respiratory syndrome virus
WQKRHST

SEQ ID NO: 1237 - protein, 17 aa, Human severe acute respiratory syndrome virus
RLKKMLSCRAQSNQQHN

SEQ ID NO: 1238 - protein, 13 aa, Human severe acute respiratory syndrome virus
KFFFSPMHRQKGI

SEQ ID NO: 1239 - protein, 9 aa, Human severe acute respiratory syndrome virus
KPLQKDTSL

SEQ ID NO: 1240 - protein, 11 aa, Human severe acute respiratory syndrome virus
GISQHLLREQP

SEQ ID NO: 1241 - protein, 12 aa, Human severe acute respiratory syndrome virus
RSGKFLCQSQSS

SEQ ID NO: 1242 - protein, 13 aa, Human severe acute respiratory syndrome virus
VQQVDFENNQQHL

SEQ ID NO: 1243 - protein, 7 aa, Human severe acute respiratory syndrome virus
LYHFHHT

SEQ ID NO: 1244 - protein, 24 aa, Human severe acute respiratory syndrome virus
LALNSQQNRLQLTCPKCLEQVKRL

SEQ ID NO: 1245 - protein, 5 aa, Human severe acute respiratory syndrome virus
YQEAT

SEQ ID NO: 1246 - protein, 4 aa, Human severe acute respiratory syndrome virus
VSKC

SEQ ID NO: 1247 - protein, 10 aa, Human severe acute respiratory syndrome virus
NQKVDHELHL

SEQ ID NO: 1248 - protein, 14 aa, Human severe acute respiratory syndrome virus
VDSPYKHRETHLYF

SEQ ID NO: 1249 - protein, 7 aa, Human severe acute respiratory syndrome virus
TQTLVSV

SEQ ID NO: 1250 - protein, 21 aa, Human severe acute respiratory syndrome virus
NYLTFLKHQAKRHQICTRKCN

SEQ ID NO: 1251 - protein, 6 aa, Human severe acute respiratory syndrome virus
MHYRIS

SEQ ID NO: 1252 - protein, 8 aa, Human severe acute respiratory syndrome virus
YVSVYPWV

SEQ ID NO: 1253 - protein, 16 aa, Human severe acute respiratory syndrome virus
KQQRKGCHTIQSYMLV

SEQ ID NO: 1254 - protein, 9 aa, Human severe acute respiratory syndrome virus
SPTVTCCSW

SEQ ID NO: 1255 - protein, 21 aa, Human severe acute respiratory syndrome virus
NQKPNHGQHLISLWQQNKYHP

SEQ ID NO: 1256 - protein, 7 aa, Human severe acute respiratory syndrome virus
QGCQTYD

SEQ ID NO: 1257 - protein, 4 aa, Human severe acute respiratory syndrome virus
YETL

SEQ ID NO: 1258 - protein, 16 aa, Human severe acute respiratory syndrome virus
NKMEEINPELNKECLI

SEQ ID NO: 1259 - protein, 10 aa, Human severe acute respiratory syndrome virus
KFHQDSKPPS

SEQ ID NO: 1260 - protein, 7 aa, Human severe acute respiratory syndrome virus
MKYVECN

SEQ ID NO: 1261 - protein, 16 aa, Human severe acute respiratory syndrome virus
ELEHHQKWCTGQGHYH

SEQ ID NO: 1262 - protein, 5 aa, Human severe acute respiratory syndrome virus
EIIRK

SEQ ID NO: 1263 - protein, 6 aa, Human severe acute respiratory syndrome virus
TCSFSC

SEQ ID NO: 1264 - protein, 13 aa, Human severe acute respiratory syndrome virus
QEYHLKPQLCCFL

SEQ ID NO: 1265 - protein, 12 aa, Human severe acute respiratory syndrome virus
AYLFPEENKSYH

SEQ ID NO: 1266 - protein, 4 aa, Human severe acute respiratory syndrome virus
FDSP

SEQ ID NO: 1267 - protein, 9 aa, Human severe acute respiratory syndrome virus
ETLQQFLLI

SEQ ID NO: 1268 - protein, 15 aa, Human severe acute respiratory syndrome virus
EEICSCQRVNRKTTG

SEQ ID NO: 1269 - protein, 9 aa, Human severe acute respiratory syndrome virus
DLCSSRKCS

SEQ ID NO: 1270 - protein, 16 aa, Human severe acute respiratory syndrome virus
HAWYSHQFVPSACQDS

SEQ ID NO: 1271 - protein, 14 aa, Human severe acute respiratory syndrome virus
PQLKMLPMMMHLHL

SEQ ID NO: 1272 - protein, 10 aa, Human severe acute respiratory syndrome virus
QKLSTMRNGP

SEQ ID NO: 1273 - protein, 16 aa, Human severe acute respiratory syndrome virus
ACKGQHSKNALLSLQL

SEQ ID NO: 1274 - protein, 9 aa, Human severe acute respiratory syndrome virus
NHPGLVFAL

SEQ ID NO: 1275 - protein, 5 aa, Human severe acute respiratory syndrome virus
IHTDK

SEQ ID NO: 1276 - protein, 4 aa, Human severe acute respiratory syndrome virus
KTLL

SEQ ID NO: 1277 - protein, 10 aa, Human severe acute respiratory syndrome virus
SHSLLSHVWS

SEQ ID NO: 1278 - protein, 5 aa, Human severe acute respiratory syndrome virus
GHTYR

SEQ ID NO: 1279 - protein, 4 aa, Human severe acute respiratory syndrome virus
GPIY

SEQ ID NO: 1280 - protein, 11 aa, Human severe acute respiratory syndrome virus
PYVLLHSLQLK

SEQ ID NO: 1281 - protein, 8 aa, Human severe acute respiratory syndrome virus
NLRRRRSH

SEQ ID NO: 1282 - protein, 14 aa, Human severe acute respiratory syndrome virus
DLNRQVVCQLATIV

SEQ ID NO: 1283 - protein, 17 aa, Human severe acute respiratory syndrome virus
AQLYLVQLLYQSQHQSE

SEQ ID NO: 1284 - protein, 9 aa, Human severe acute respiratory syndrome virus
LSCCRVQLK

SEQ ID NO: 1285 - protein, 21 aa, Human severe acute respiratory syndrome virus
VYLSIDTVEYTLRHSSLFLLV

SEQ ID NO: 1286 - protein, 22 aa, Human severe acute respiratory syndrome virus
QHFHHNSEGHTFQEAFFASCTS

SEQ ID NO: 1287 - protein, 28 aa, Human severe acute respiratory syndrome virus
ASQHLVATLDLLVVLGRRFQHVHPYTKA

SEQ ID NO: 1288 - protein, 8 aa, Human severe acute respiratory syndrome virus
MKFQHSQL

SEQ ID NO: 1289 - protein, 38 aa, Human severe acute respiratory syndrome virus
PLLKSLTNLVTLLSRQSHQVKDQSQNTHILMNLFAHLL

SEQ ID NO: 1290 - protein, 8 aa, Human severe acute respiratory syndrome virus
SNFSLCCP

SEQ ID NO: 1291 - protein, 4 aa, Human severe acute respiratory syndrome virus
NPLI

SEQ ID NO: 1292 - protein, 22 aa, Human severe acute respiratory syndrome virus
VVNLVSAWLSLSLNEDRQVVHD

SEQ ID NO: 1293 - protein, 18 aa, Human severe acute respiratory syndrome virus
NLHKRCVRRHSPRAYIAV

SEQ ID NO: 1294 - protein, 13 aa, Human severe acute respiratory syndrome virus
RARESQFPFVIWA

SEQ ID NO: 1295 - protein, 8 aa, Human severe acute respiratory syndrome virus
NPLSLCSE

SEQ ID NO: 1296 - protein, 8 aa, Human severe acute respiratory syndrome virus
SRFQATVE

SEQ ID NO: 1297 - protein, 5 aa, Human severe acute respiratory syndrome virus
CRLLS

SEQ ID NO: 1298 - protein, 10 aa, Human severe acute respiratory syndrome virus
TVFLLILQLM

SEQ ID NO: 1299 - protein, 11 aa, Human severe acute respiratory syndrome virus
LVLVPLKVLDL

SEQ ID NO: 1300 - protein, 13 aa, Human severe acute respiratory syndrome virus
LNLLLLKHHYGRF

SEQ ID NO: 1301 - protein, 14 aa, Human severe acute respiratory syndrome virus
KGLPVLPLYHQTRQ

SEQ ID NO: 1302 - protein, 7 aa, Human severe acute respiratory syndrome virus
VKNKHSQ

SEQ ID NO: 1303 - protein, 13 aa, Human severe acute respiratory syndrome virus
VSWQCQSLCRHLL

SEQ ID NO: 1304 - protein, 15 aa, Human severe acute respiratory syndrome virus
IHVLGLLFCSPRLQY

SEQ ID NO: 1305 - protein, 8 aa, Human severe acute respiratory syndrome virus
QRYQHPNY

SEQ ID NO: 1306 - protein, 5 aa, Human severe acute respiratory syndrome virus
SLALV

SEQ ID NO: 1307 - protein, 7 aa, Human severe acute respiratory syndrome virus
PKAQMQH

SEQ ID NO: 1308 - protein, 23 aa, Human severe acute respiratory syndrome virus
QEVLSYFQRSPHQYHLPLCKQHY

SEQ ID NO: 1309 - protein, 15 aa, Human severe acute respiratory syndrome virus
WKQVLRRRVHQSVLY

SEQ ID NO: 1310 - protein, 13 aa, Human severe acute respiratory syndrome virus
QHYKPHFLNSVTW

SEQ ID NO: 1311 - protein, 16 aa, Human severe acute respiratory syndrome virus
MYSTGYKYQIVCKSIG

SEQ ID NO: 1312 - protein, 31 aa, Human severe acute respiratory syndrome virus
IQQKSSYYMHPSTVGTHLHGVCKQHHLNCIV

SEQ ID NO: 1313 - protein, 30 aa, Human severe acute respiratory syndrome virus
VEHNQYPTLLVCHETHKDYQNSKRKAIALN

SEQ ID NO: 1314 - protein, 58 aa, Human severe acute respiratory syndrome virus
MHFYRKLECGMHAYSHTNYHHHSLVSSSLTRLLCQTYTQLHWLGNDQRYNSKTNKHHQ

SEQ ID NO: 1315 - protein, 5 aa, Human severe acute respiratory syndrome virus
IYRDV

SEQ ID NO: 1316 - protein, 32 aa, Human severe acute respiratory syndrome virus
HKNRRVPLFCKLCHYMAEHRRTSILLQPEAHT

SEQ ID NO: 1317 - protein, 31 aa, Human severe acute respiratory syndrome virus
PLDFQCHEELETYQQAMQTSQPCVVLFCKQN

SEQ ID NO: 1318 - protein, 6 aa, Human severe acute respiratory syndrome virus
PSVHLL

SEQ ID NO: 1319 - protein, 9 aa, Human severe acute respiratory syndrome virus
GIQQTNQRA

SEQ ID NO: 1320 - protein, 9 aa, Human severe acute respiratory syndrome virus
QSTHGLLNI

SEQ ID NO: 1321 - protein, 20 aa, Human severe acute respiratory syndrome virus
PHVHFHVPGNVGHGYSEGYP

SEQ ID NO: 1322 - protein, 8 aa, Human severe acute respiratory syndrome virus
SPTAEHQS

SEQ ID NO: 1323 - protein, 21 aa, Human severe acute respiratory syndrome virus
MGYRHSQNPQNDSSRHKYLMK

SEQ ID NO: 1324 - protein, 18 aa, Human severe acute respiratory syndrome virus
KSKLHVCHTDNTFFQVQS

SEQ ID NO: 1325 - protein, 6 aa, Human severe acute respiratory syndrome virus
QSTSLM

SEQ ID NO: 1326 - protein, 21 aa, Human severe acute respiratory syndrome virus
AQSHAPKGRTRLCLTILSVYH

SEQ ID NO: 1327 - protein, 5 aa, Human severe acute respiratory syndrome virus
AFVLS

SEQ ID NO: 1328 - protein, 11 aa, Human severe acute respiratory syndrome virus
YALHSRASLYT

SEQ ID NO: 1329 - protein, 9 aa, Human severe acute respiratory syndrome virus
TGHLVEVLH

SEQ ID NO: 1330 - protein, 17 aa, Human severe acute respiratory syndrome virus
ILCYFQCQHNQSVQLLS

SEQ ID NO: 1331 - protein, 8 aa, Human severe acute respiratory syndrome virus
KILAGEVG

SEQ ID NO: 1332 - protein, 5 aa, Human severe acute respiratory syndrome virus
YPQHL

SEQ ID NO: 1333 - protein, 17 aa, Human severe acute respiratory syndrome virus
LHDSPLHQSQSTHERDE

SEQ ID NO: 1334 - protein, 4 aa, Human severe acute respiratory syndrome virus
LLRG

SEQ ID NO: 1335 - protein, 5 aa, Human severe acute respiratory syndrome virus
LGNSF

SEQ ID NO: 1336 - protein, 20 aa, Human severe acute respiratory syndrome virus
VYGRSCPLVCLVCQHIILQS

SEQ ID NO: 1337 - protein, 5 aa, Human severe acute respiratory syndrome virus
ILYQR

SEQ ID NO: 1338 - protein, 4 aa, Human severe acute respiratory syndrome virus
DEDQ

SEQ ID NO: 1339 - protein, 5 aa, Human severe acute respiratory syndrome virus
SYYSP

SEQ ID NO: 1340 - protein, 10 aa, Human severe acute respiratory syndrome virus
KVQLHFLLVM

SEQ ID NO: 1341 - protein, 10 aa, Human severe acute respiratory syndrome virus
PHCDVVFLDL

SEQ ID NO: 1342 - protein, 21 aa, Human severe acute respiratory syndrome virus
IAVCHKDLYQTLCTKCQFLPL

SEQ ID NO: 1343 - protein, 8 aa, Human severe acute respiratory syndrome virus
HYKSVLFQ

SEQ ID NO: 1344 - protein, 14 aa, Human severe acute respiratory syndrome virus
HSHIQNPVMNQQSA

SEQ ID NO: 1345 - protein, 17 aa, Human severe acute respiratory syndrome virus
AILRFLKLQRSVNYKVR

SEQ ID NO: 1346 - protein, 10 aa, Human severe acute respiratory syndrome virus
KQLFSKQDCV

SEQ ID NO: 1347 - protein, 11 aa, Human severe acute respiratory syndrome virus
EILLQRLFEVC

SEQ ID NO: 1348 - protein, 7 aa, Human severe acute respiratory syndrome virus
LQMKHHV

SEQ ID NO: 1349 - protein, 6 aa, Human severe acute respiratory syndrome virus
HLCRTF

SEQ ID NO: 1350 - protein, 43 aa, Human severe acute respiratory syndrome virus
SIELTYPCVLLAYCHKLKHSQCQQFQQDNGDKFQGTCLDLLFS

SEQ ID NO: 1351 - protein, 5 aa, Human severe acute respiratory syndrome virus
VCTLN

SEQ ID NO: 1352 - protein, 8 aa, Human severe acute respiratory syndrome virus
NILVLVCL

SEQ ID NO: 1353 - protein, 23 aa, Human severe acute respiratory syndrome virus
SAMCGGLVIEQDRQYRRSVLHEV

SEQ ID NO: 1354 - protein, 6 aa, Human severe acute respiratory syndrome virus
QHSSHN

SEQ ID NO: 1355 - protein, 30 aa, Human severe acute respiratory syndrome virus
RFHQRLQCQQLFLAMHLQCRKHTVLVLNSL

SEQ ID NO: 1356 - protein, 12 aa, Human severe acute respiratory syndrome virus
IYQNTLRAHAQV

SEQ ID NO: 1357 - protein, 54 aa, Human severe acute respiratory syndrome virus
FYYIYLWANILMPFHIGHQQLHESMPYTLCEQMGNREQVRWQNDSYQYQVVLGV

SEQ ID NO: 1358 - protein, 14 aa, Human severe acute respiratory syndrome virus
STFACRPFDNLQHC

SEQ ID NO: 1359 - protein, 6 aa, Human severe acute respiratory syndrome virus
KTHLRC

SEQ ID NO: 1360 - protein, 6 aa, Human severe acute respiratory syndrome virus
VLGTSQ

SEQ ID NO: 1361 - protein, 10 aa, Human severe acute respiratory syndrome virus
FSHSALVALE

SEQ ID NO: 1362 - protein, 20 aa, Human severe acute respiratory syndrome virus
VALQCEMSTQSNHQHSTCMS

SEQ ID NO: 1363 - protein, 25 aa, Human severe acute respiratory syndrome virus
YLCTQQHHHSHLFQRCTLQSVLYYF

SEQ ID NO: 1364 - protein, 5 aa, Human severe acute respiratory syndrome virus
LHGNQ

SEQ ID NO: 1365 - protein, 9 aa, Human severe acute respiratory syndrome virus
RHSFCSMVV

SEQ ID NO: 1366 - protein, 26 aa, Human severe acute respiratory syndrome virus
VFQPPMKDAILCQRVLRVQWQYHMTA

SEQ ID NO: 1367 - protein, 6 aa, Human severe acute respiratory syndrome virus
MFPQWL

SEQ ID NO: 1368 - protein, 7 aa, Human severe acute respiratory syndrome virus
AFLLRKA

SEQ ID NO: 1369 - protein, 14 aa, Human severe acute respiratory syndrome virus
VSQYKCWQVCNRQH

SEQ ID NO: 1370 - protein, 8 aa, Human severe acute respiratory syndrome virus
SNHMLLSH

SEQ ID NO: 1371 - protein, 17 aa, Human severe acute respiratory syndrome virus
HCHCLHMCFCINQKPDH

SEQ ID NO: 1372 - protein, 5 aa, Human severe acute respiratory syndrome virus
HIMEN

SEQ ID NO: 1373 - protein, 21 aa, Human severe acute respiratory syndrome virus
WEAYVTCNNSSYLLDTVVSHQ

SEQ ID NO: 1374 - protein, 11 aa, Human severe acute respiratory syndrome virus
HHNLGHCKHRD

SEQ ID NO: 1375 - protein, 10 aa, Human severe acute respiratory syndrome virus
QTTLICVMLK

SEQ ID NO: 1376 - protein, 13 aa, Human severe acute respiratory syndrome virus
HGHSSTCNIGMVS

SEQ ID NO: 1377 - protein, 28 aa, Human severe acute respiratory syndrome virus
YRHRNEVKSVNCTIHKHLQPARLYVVCT

SEQ ID NO: 1378 - protein, 14 aa, Human severe acute respiratory syndrome virus
PHKTQVPSTVRCYH

SEQ ID NO: 1379 - protein, 12 aa, Human severe acute respiratory syndrome virus
LALRNTCPTCGQ

SEQ ID NO: 1380 - protein, 6 aa, Human severe acute respiratory syndrome virus
AHHVTF

SEQ ID NO: 1381 - protein, 14 aa, Human severe acute respiratory syndrome virus
CIVNTSERHQHTPD

SEQ ID NO: 1382 - protein, 5 aa, Human severe acute respiratory syndrome virus
VGKHQ

SEQ ID NO: 1383 - protein, 8 aa, Human severe acute respiratory syndrome virus
PVTRTFQS

SEQ ID NO: 1384 - protein, 5 aa, Human severe acute respiratory syndrome virus
VYHLF

SEQ ID NO: 1385 - protein, 27 aa, Human severe acute respiratory syndrome virus
QYHRQNSLRLIFLMDLGKAGTRNHLLV

SEQ ID NO: 1386 - protein, 13 aa, Human severe acute respiratory syndrome virus
LALYAVSKIREVL

SEQ ID NO: 1387 - protein, 11 aa, Human severe acute respiratory syndrome virus
GQSQSNILPQT

SEQ ID NO: 1388 - protein, 10 aa, Human severe acute respiratory syndrome virus
THYFDNKELP

SEQ ID NO: 1389 - protein, 76 aa, Human severe acute respiratory syndrome virus
LLNLEPHSYCYSTQRHHQKESSWRNVYAGKRKTHPRIHDQHPYFYRDTHRACVVDCGHTCQLSYYHQLKEVHLHWL

SEQ ID NO: 1390 - protein, 5 aa, Human severe acute respiratory syndrome virus
QLDKC

SEQ ID NO: 1391 - protein, 4 aa, Human severe acute respiratory syndrome virus
HKQL

SEQ ID NO: 1392 - protein, 9 aa, Human severe acute respiratory syndrome virus
HHRMMFHLV

SEQ ID NO: 1393 - protein, 7 aa, Human severe acute respiratory syndrome virus
HIVSRHT

SEQ ID NO: 1394 - protein, 10 aa, Human severe acute respiratory syndrome virus
PSHLILAHTR

SEQ ID NO: 1395 - protein, 25 aa, Human severe acute respiratory syndrome virus
LTCRNGVISYSKCYVCEQEQERPLS

SEQ ID NO: 1396 - protein, 12 aa, Human severe acute respiratory syndrome virus
AWLCHILDNPNP

SEQ ID NO: 1397 - protein, 28 aa, Human severe acute respiratory syndrome virus
GVEFLHHCKQFLTYYASHRKTCLFQLPQ

SEQ ID NO: 1398 - protein, 16 aa, Human severe acute respiratory syndrome virus
WRLLTSIISDETVYLS

SEQ ID NO: 1399 - protein, 12 aa, Human severe acute respiratory syndrome virus
RHQLRCELYSLH

SEQ ID NO: 1400 - protein, 5 aa, Human severe acute respiratory syndrome virus
DSFEL

SEQ ID NO: 1401 - protein, 18 aa, Human severe acute respiratory syndrome virus
YTRKVHLDPHNSLSHNKV

SEQ ID NO: 1402 - protein, 5 aa, Human severe acute respiratory syndrome virus
PYPIY

SEQ ID NO: 1403 - protein, 10 aa, Human severe acute respiratory syndrome virus
MGNQLIYPDC

SEQ ID NO: 1404 - protein, 6 aa, Human severe acute respiratory syndrome virus
RLLGWH

SEQ ID NO: 1405 - protein, 21 aa, Human severe acute respiratory syndrome virus
YSHHRNNQSIYQQLQLRIGVV

SEQ ID NO: 1406 - protein, 15 aa, Human severe acute respiratory syndrome virus
YHTLLADYNDNSHNH

SEQ ID NO: 1407 - protein, 19 aa, Human severe acute respiratory syndrome virus
QRCHPEQRRSVLVQQNFLP

SEQ ID NO: 1408 - protein, 9 aa, Human severe acute respiratory syndrome virus
TQQSHKSLY

SEQ ID NO: 1409 - protein, 4 aa, Human severe acute respiratory syndrome virus
NYRV

SEQ ID NO: 1410 - protein, 16 aa, Human severe acute respiratory syndrome virus
QFEKQHCLLVQLLKSM

SEQ ID NO: 1411 - protein, 13 aa, Human severe acute respiratory syndrome virus
CVYLAINCQKLHA

SEQ ID NO: 1412 - protein, 10 aa, Human severe acute respiratory syndrome virus
LDQQHTLKVP

SEQ ID NO: 1413 - protein, 42 aa, Human severe acute respiratory syndrome virus
DASYVSLHPDYVRLLTHENGIQLKQQKEHHLQIFFLLVVQNL

SEQ ID NO: 1414 - protein, 4 aa, Human severe acute respiratory syndrome virus
VETQ

SEQ ID NO: 1415 - protein, 4 aa, Human severe acute respiratory syndrome virus
KITH

SEQ ID NO: 1416 - protein, 13 aa, Human severe acute respiratory syndrome virus
SLHNEGYTYHPNS

SEQ ID NO: 1417 - protein, 11 aa, Human severe acute respiratory syndrome virus
YNWDGMSGPNI

SEQ ID NO: 1418 - protein, 11 aa, Human severe acute respiratory syndrome virus
NNGRRDKVSLP

SEQ ID NO: 1419 - protein, 8 aa, Human severe acute respiratory syndrome virus
NHISANPT

SEQ ID NO: 1420 - protein, 16 aa, Human severe acute respiratory syndrome virus
VVLRDQHPYGTQQPMP

SEQ ID NO: 1421 - protein, 12 aa, Human severe acute respiratory syndrome virus
GWASAMSNMNPQ

SEQ ID NO: 1422 - protein, 19 aa, Human severe acute respiratory syndrome virus
ELRSLVLLVRNHRNRTSSH

SEQ ID NO: 1423 - protein, 16 aa, Human severe acute respiratory syndrome virus
DPDYLMSVRLQCLHHA

SEQ ID NO: 1424 - protein, 18 aa, Human severe acute respiratory syndrome virus
HRRIVQSLIMIGVHAHLS

SEQ ID NO: 1425 - protein, 18 aa, Human severe acute respiratory syndrome virus
HIRVRCQDSLRSHTNPSY

SEQ ID NO: 1426 - protein, 9 aa, Human severe acute respiratory syndrome virus
NNHHHSNCM

SEQ ID NO: 1427 - protein, 26 aa, Human severe acute respiratory syndrome virus
RVFLLMYHNYPHQNDVEHRLNQPLCI

SEQ ID NO: 1428 - protein, 15 aa, Human severe acute respiratory syndrome virus
LDADVIYVVPCHHLL

SEQ ID NO: 1429 - protein, 11 aa, Human severe acute respiratory syndrome virus
KSHGQQPLDNL

SEQ ID NO: 1430 - protein, 4 aa, Human severe acute respiratory syndrome virus
PSYK

SEQ ID NO: 1431 - protein, 6 aa, Human severe acute respiratory syndrome virus
SLHVGS

SEQ ID NO: 1432 - protein, 20 aa, Human severe acute respiratory syndrome virus
LQSKSLINCLPHPSPGSDSN

SEQ ID NO: 1433 - protein, 24 aa, Human severe acute respiratory syndrome virus
FLGTLQNQHFFRCKYQKPCRRHQY

SEQ ID NO: 1434 - protein, 6 aa, Human severe acute respiratory syndrome virus
CLCRTV

SEQ ID NO: 1435 - protein, 10 aa, Human severe acute respiratory syndrome virus
DGLHLHRKPV

SEQ ID NO: 1436 - protein, 71 aa, Human severe acute respiratory syndrome virus
CIRRLHQGFAELVTTTAITFPHSADGTDCVSKCKTHWVISTSGRYLDVLTFQVTESFRIWMVNVASTIQTT

SEQ ID NO: 1437 - protein, 40 aa, Human severe acute respiratory syndrome virus
STTKGLLVHVSFWCYSNCLSCTSVCTQHLHTVGDWLSSTC

SEQ ID NO: 1438 - protein, 19 aa, Human severe acute respiratory syndrome virus
VILICFSRVYCKSTEGKHS

SEQ ID NO: 1439 - protein, 17 aa, Human severe acute respiratory syndrome virus
IGRYFCSISSLKTYCSS

SEQ ID NO: 1440 - protein, 8 aa, Human severe acute respiratory syndrome virus
TAQHHTSI

SEQ ID NO: 1441 - protein, 47 aa, Human severe acute respiratory syndrome virus
AFDEVQVFHFRPFWCVCNKPTRWFQFCVNCTCTITLRESSPFEILVV

SEQ ID NO: 1442 - protein, 34 aa, Human severe acute respiratory syndrome virus
CQHKPTSLRIVIVGKCIVISTSCLCGTSRTGHLS

SEQ ID NO: 1443 - protein, 9 aa, Human severe acute respiratory syndrome virus
CYWTQFIIL

SEQ ID NO: 1444 - protein, 11 aa, Human severe acute respiratory syndrome virus
SCNNKRPSQIW

SEQ ID NO: 1445 - protein, 138 aa, Human severe acute respiratory syndrome virus
IVHVNFTKLNNLAIRINNLLDFPECRCICKGVTITSVLVGTIIRDNNHEFGCCSQWYDVEWNTTITRIVDNVVKCIIIKLPKHSEEHCLHSTSYFCPLVLRSCLFVHLGHSLICHLFQLALHGSITVKLRFSHIQRFL

SEQ ID NO: 1446 - protein, 26 aa, Human severe acute respiratory syndrome virus
LFENDFRITISYSLLIGLLGSGISGI

SEQ ID NO: 1447 - protein, 4 aa, Human severe acute respiratory syndrome virus
RTKF

SEQ ID NO: 1448 - protein, 26 aa, Human severe acute respiratory syndrome virus
SNSLKSSTVIEHFLAQPINVYSTLHG

SEQ ID NO: 1449 - protein, 35 aa, Human severe acute respiratory syndrome virus
QNRQKRNHLLESFSCVFCKKNIIVELYTLCPQFRR

SEQ ID NO: 1450 - protein, 83 aa, Human severe acute respiratory syndrome virus
LYSKLLKNREQYHRCALYVRHFRLYSSNLDTWFTSNTQQLNVKLESINTTLRRQKPLGVHIPKFLCRDQVVINTKSKPEVTVE

SEQ ID NO: 1451 - protein, 12 aa, Human severe acute respiratory syndrome virus
TEKAKVAAATIA

SEQ ID NO: 1452 - protein, 9 aa, Human severe acute respiratory syndrome virus
ETINKHDTL

SEQ ID NO: 1453 - protein, 6 aa, Human severe acute respiratory syndrome virus
GVASNK

SEQ ID NO: 1454 - protein, 14 aa, Human severe acute respiratory syndrome virus
QWVILNTHKHYSSS

SEQ ID NO: 1455 - protein, 17 aa, Human severe acute respiratory syndrome virus
KHDSRNDTRIVRGYRNN

SEQ ID NO: 1456 - protein, 8 aa, Human severe acute respiratory syndrome virus
GPHGNSLI

SEQ ID NO: 1457 - protein, 37 aa, Human severe acute respiratory syndrome virus
SITIVDFVNKCNDIHQCPNTSSSIIINSASCHENKQN

SEQ ID NO: 1458 - protein, 45 aa, Human severe acute respiratory syndrome virus
SIHNTILKPITRQASVSQFKPCHDTHHPASRHVDHIKVSNCCKRR

SEQ ID NO: 1459 - protein, 39 aa, Human severe acute respiratory syndrome virus
QKQAQECVLMLNKQHSTCSNCHNTKSKWQESILVNKEKQ

SEQ ID NO: 1460 - protein, 9 aa, Human severe acute respiratory syndrome virus
PLCTLNKNQ

SEQ ID NO: 1461 - protein, 4 aa, Human severe acute respiratory syndrome virus
CQES

SEQ ID NO: 1462 - protein, 34 aa, Human severe acute respiratory syndrome virus
KHPMMSALNNFLELTLEGNTRALSNNIKWCKLIF

SEQ ID NO: 1463 - protein, 24 aa, Human severe acute respiratory syndrome virus
NSATKDSTTIHTILQQLFQSSTHI

SEQ ID NO: 1464 - protein, 59 aa, Human severe acute respiratory syndrome virus
DGNSCLSRKRSQYVNMILCQRFIVVLHCHKVKVIQSSGESIKKPPITIDNSSIQPCQNI

SEQ ID NO: 1465 - protein, 24 aa, Human severe acute respiratory syndrome virus
CYGCVCTCSLCSLSVNKWTIEFTF

SEQ ID NO: 1466 - protein, 32 aa, Human severe acute respiratory syndrome virus
VSTSVYSCWKLHMMHIAERHAIIINVKTNTTT

SEQ ID NO: 1467 - protein, 22 aa, Human severe acute respiratory syndrome virus
SIKERTFNGMIRSHGTLINTRW

SEQ ID NO: 1468 - protein, 5 aa, Human severe acute respiratory syndrome virus
TIVAC

SEQ ID NO: 1469 - protein, 102 aa, Human severe acute respiratory syndrome virus
KCLTRLDTDKFILGCLRVRSINFKPKQTILHRMANNTKLNIASLNKKAMVGFANEQIFIVRIKHVFCCANDMSWTVYCVIQPQSIKSCSSTGYLYHAPFNFA

SEQ ID NO: 1470 - protein, 16 aa, Human severe acute respiratory syndrome virus
RECHFPKTTLQNSRSD

SEQ ID NO: 1471 - protein, 11 aa, Human severe acute respiratory syndrome virus
CLWWLVENIST

SEQ ID NO: 1472 - protein, 5 aa, Human severe acute respiratory syndrome virus
VAKVI

SEQ ID NO: 1473 - protein, 12 aa, Human severe acute respiratory syndrome virus
VAASCFTIAGSI

SEQ ID NO: 1474 - protein, 10 aa, Human severe acute respiratory syndrome virus
GSTEILVLVI

SEQ ID NO: 1475 - protein, 18 aa, Human severe acute respiratory syndrome virus
SKIPVILCKWQQCLATQF

SEQ ID NO: 1476 - protein, 69 aa, Human severe acute respiratory syndrome virus
VHFLVEQKGTQSSLLEGTKCNSIKHDSFPKIVVKEPMAVLQRNTEYIDCCYPKRHNRRKHGKPLKVSQE

SEQ ID NO: 1477 - protein, 14 aa, Human severe acute respiratory syndrome virus
NIIGEIECQVQVKD

SEQ ID NO: 1478 - protein, 59 aa, Human severe acute respiratory syndrome virus
VDSRQKAVSWYQTEYSERHQKQKCISSNNMVVLTKNTSEFHKVVGSTSHQYGNNTTSHY

SEQ ID NO: 1479 - protein, 4 aa, Human severe acute respiratory syndrome virus
SRHI

SEQ ID NO: 1480 - protein, 25 aa, Human severe acute respiratory syndrome virus
STHRLHKRSKDVSYEIHRINTTENS

SEQ ID NO: 1481 - protein, 15 aa, Human severe acute respiratory syndrome virus
SSVMLIIKNPSTTGR

SEQ ID NO: 1482 - protein, 5 aa, Human severe acute respiratory syndrome virus
ANTYF

SEQ ID NO: 1483 - protein, 52 aa, Human severe acute respiratory syndrome virus
PFACTMSTVLSIKSCYYSNRTLQVSVRKLYDGTIHKHITSVWTKLTIRNRTL

SEQ ID NO: 1484 - protein, 53 aa, Human severe acute respiratory syndrome virus
QISVITIWHRFAHSILKNCTLSSKNASRGSKITILNEFGRCVANVANSTKNTR

SEQ ID NO: 1485 - protein, 15 aa, Human severe acute respiratory syndrome virus
KMQEVTIDCSQHSTR

SEQ ID NO: 1486 - protein, 24 aa, Human severe acute respiratory syndrome virus
ARHYETNLSCNDSSYYRAAFVIFV

SEQ ID NO: 1487 - protein, 46 aa, Human severe acute respiratory syndrome virus
TTTLAKPCVKTSMFICKTIISRNDVTSDTILNGFVTNDFICVTIMD

SEQ ID NO: 1488 - protein, 18 aa, Human severe acute respiratory syndrome virus
QCMYWHNDITNQCSKNAQ

SEQ ID NO: 1489 - protein, 18 aa, Human severe acute respiratory syndrome virus
CGLKHKFKTSTNNLTTLE

SEQ ID NO: 1490 - protein, 16 aa, Human severe acute respiratory syndrome virus
DFSSYDIDNLSSCSTS

SEQ ID NO: 1491 - protein, 20 aa, Human severe acute respiratory syndrome virus
CKRYVVLLGSSTNLFTQLFR

SEQ ID NO: 1492 - protein, 10 aa, Human severe acute respiratory syndrome virus
RHVVFYIPDE

SEQ ID NO: 1493 - protein, 46 aa, Human severe acute respiratory syndrome virus
NIVTFCYLGIDMPCITVNTCAKISGRHVFNLIIGEHEIVTTVTCHF

SEQ ID NO: 1494 - protein, 4 aa, Human severe acute respiratory syndrome virus
VRVM

SEQ ID NO: 1495 - protein, 22 aa, Human severe acute respiratory syndrome virus
KFETFNNILCVNIGINNTLSGS

SEQ ID NO: 1496 - protein, 8 aa, Human severe acute respiratory syndrome virus
HECRKDTI

SEQ ID NO: 1497 - protein, 5 aa, Human severe acute respiratory syndrome virus
SYTLC

SEQ ID NO: 1498 - protein, 20 aa, Human severe acute respiratory syndrome virus
LAVSCSNKCLKFFHRNTKSC

SEQ ID NO: 1499 - protein, 20 aa, Human severe acute respiratory syndrome virus
KGVDISIKHLNGNFSTISNV

SEQ ID NO: 1500 - protein, 42 aa, Human severe acute respiratory syndrome virus
YKSLVKQQNRLAHQLTVVHRSRLRSRLVAFGLAIKNYDINRQ

SEQ ID NO: 1501 - protein, 10 aa, Human severe acute respiratory syndrome virus
TFSVVSSQIV

SEQ ID NO: 1502 - protein, 36 aa, Human severe acute respiratory syndrome virus
IDKMGERMSLIGLLTSLVKVEVKRAIFHSNTINNIR

SEQ ID NO: 1503 - protein, 12 aa, Human severe acute respiratory syndrome virus
LVSRVDWSFKLE

SEQ ID NO: 1504 - protein, 129 aa, Human severe acute respiratory syndrome virus
QITSNFITNECTTSAKCVTIETIPIVSLAEATASICIDIERSLHAINNSCTLNACGTIALIAHHASRRGATIHDMNIALPYVVERSKEDVHPNHCRNGCHLYNTNDKPHEPRIADEMTSKIAKEHLHYS

SEQ ID NO: 1505 - protein, 18 aa, Human severe acute respiratory syndrome virus
IKEFCEQHICQNPLSGQT

SEQ ID NO: 1506 - protein, 4 aa, Human severe acute respiratory syndrome virus
NCQV

SEQ ID NO: 1507 - protein, 16 aa, Human severe acute respiratory syndrome virus
NRHLNGFKSWIRIKGV

SEQ ID NO: 1508 - protein, 37 aa, Human severe acute respiratory syndrome virus
TNAARKRTFTEIHSSNVRRIKIQFSNAITIRRSTKIR

SEQ ID NO: 1509 - protein, 10 aa, Human severe acute respiratory syndrome virus
EYTKSSSYTD

SEQ ID NO: 1510 - protein, 12 aa, Human severe acute respiratory syndrome virus
PHSDCEQFRKFG

SEQ ID NO: 1511 - protein, 10 aa, Human severe acute respiratory syndrome virus
LHIINAGIQT

SEQ ID NO: 1512 - protein, 14 aa, Human severe acute respiratory syndrome virus
FSNTLNTIFSNSCR

SEQ ID NO: 1513 - protein, 17 aa, Human severe acute respiratory syndrome virus
SSNSRIGTFSKSTQLEQ

SEQ ID NO: 1514 - protein, 14 aa, Human severe acute respiratory syndrome virus
CKHIRHIIVKHTLC

SEQ ID NO: 1515 - protein, 5 aa, Human severe acute respiratory syndrome virus
SLSAI

SEQ ID NO: 1516 - protein, 7 aa, Human severe acute respiratory syndrome virus
CCNCCLS

SEQ ID NO: 1517 - protein, 26 aa, Human severe acute respiratory syndrome virus
EWFDISQNFTPRNTINCSNTMSGNCF

SEQ ID NO: 1518 - protein, 23 aa, Human severe acute respiratory syndrome virus
KLIRFLNGNACVFHISSHKILMT

SEQ ID NO: 1519 - protein, 9 aa, Human severe acute respiratory syndrome virus
LLCYFNTFI

SEQ ID NO: 1520 - protein, 55 aa, Human severe acute respiratory syndrome virus
WFKYDIAYNFGSFHVTLYDFLLYGRIFHYFFRGGLLTFTSKIVHSLCVFYCQNFK

SEQ ID NO: 1521 - protein, 11 aa, Human severe acute respiratory syndrome virus
SIYWLCTPKTT

SEQ ID NO: 1522 - protein, 24 aa, Human severe acute respiratory syndrome virus
TPSVWFERCLGCSLVNVPNNWLMQ

SEQ ID NO: 1523 - protein, 8 aa, Human severe acute respiratory syndrome virus
FSTFLETR

SEQ ID NO: 1524 - protein, 20 aa, Human severe acute respiratory syndrome virus
IVSIVNSHYIAIQVWEECDR

SEQ ID NO: 1525 - protein, 10 aa, Human severe acute respiratory syndrome virus
SWLCEACHLI

SEQ ID NO: 1526 - protein, 20 aa, Human severe acute respiratory syndrome virus
IISKFCVRTCEFEIIKTRIW

SEQ ID NO: 1527 - protein, 62 aa, Human severe acute respiratory syndrome virus
WLSWYKVYRLLCIVSIILFIIPIQFWFNLCVSNSIEFIRHRLDGCSVRCFLVENISHWSFVL

SEQ ID NO: 1528 - protein, 34 aa, Human severe acute respiratory syndrome virus
HLCKVSSVNTIEGLLSSYMSVMTTLIVTSVLIRT

SEQ ID NO: 1529 - protein, 5 aa, Human severe acute respiratory syndrome virus
ECTLL

SEQ ID NO: 1530 - protein, 18 aa, Human severe acute respiratory syndrome virus
FILSRWCRHHNKRRLLLY

SEQ ID NO: 1531 - protein, 22 aa, Human severe acute respiratory syndrome virus
ILCSITTTHTWNGNTCLKIIIR

SEQ ID NO: 1532 - protein, 11 aa, Human severe acute respiratory syndrome virus
STHIHHSFYTR

SEQ ID NO: 1533 - protein, 25 aa, Human severe acute respiratory syndrome virus
GSSFLTTMFTHHIKNSLCRFQISML

SEQ ID NO: 1534 - protein, 54 aa, Human severe acute respiratory syndrome virus
KMGHSFSDITKLANSFITVSEYECTKVSSITSTGSIISLLKCWCIEFDFKLLKC

SEQ ID NO: 1535 - protein, 13 aa, Human severe acute respiratory syndrome virus
NTRQITIVISPFN

SEQ ID NO: 1536 - protein, 13 aa, Human severe acute respiratory syndrome virus
TTNLRKFPFLCVV

SEQ ID NO: 1537 - protein, 22 aa, Human severe acute respiratory syndrome virus
SRHVPTKKTLIKSMVVLESFTT

SEQ ID NO: 1538 - protein, 5 aa, Human severe acute respiratory syndrome virus
CVITR

SEQ ID NO: 1539 - protein, 60 aa, Human severe acute respiratory syndrome virus
YKESLTLMIYMRFNFCNISTIQVCWTKLLSICHRHIHKLCVEISVVHSCEHFYSLNLPQG

SEQ ID NO: 1540 - protein, 29 aa, Human severe acute respiratory syndrome virus
KNLTVKMKLDGALQSVVHNFVTTLKKFNT

SEQ ID NO: 1541 - protein, 5 aa, Human severe acute respiratory syndrome virus
LCTLS

SEQ ID NO: 1542 - protein, 22 aa, Human severe acute respiratory syndrome virus
IGPISVRASQRNCFYKVLLRCL

SEQ ID NO: 1543 - protein, 13 aa, Human severe acute respiratory syndrome virus
RSEVSIICSNSIW

SEQ ID NO: 1544 - protein, 34 aa, Human severe acute respiratory syndrome virus
HYGRSFKRTHTARSLFKIKTMCHITNWHCDKRLI

SEQ ID NO: 1545 - protein, 52 aa, Human severe acute respiratory syndrome virus
RVQLRNNRSYRLFTSIKEESDTIVNDALLNFNSFILTLDGCHYGSNIHAYRH

SEQ ID NO: 1546 - protein, 19 aa, Human severe acute respiratory syndrome virus
FSCLFSMSKHFSQIPGYSS

SEQ ID NO: 1547 - protein, 9 aa, Human severe acute respiratory syndrome virus
NLFLSIRCF

SEQ ID NO: 1548 - protein, 41 aa, Human severe acute respiratory syndrome virus
YIKCRFAFLKSSLSFLKCITSTSLSRVRGYILINWHFLQSS

SEQ ID NO: 1549 - protein, 60 aa, Human severe acute respiratory syndrome virus
EHLSSATSLFGGYYNTSDITTSDNITYHVRCILLKERHIFTSKHVLRIMVKLTIDISKQE

SEQ ID NO: 1550 - protein, 88 aa, Human severe acute respiratory syndrome virus
LIGKKLSFFQCCGNLINAGLNFWLHIDRLLYDRFLLSFGIFCVWWLLLFRCFHSRLQVIKIIHDNLLIKSFVIDCNINLCTNRLHAHL

SEQ ID NO: 1551 - protein, 11 aa, Human severe acute respiratory syndrome virus
RLKWFSTKYAC

SEQ ID NO: 1552 - protein, 5 aa, Human severe acute respiratory syndrome virus
QQWCK

SEQ ID NO: 1553 - protein, 17 aa, Human severe acute respiratory syndrome virus
IEIFICCLKKLDVLTCI

SEQ ID NO: 1554 - protein, 28 aa, Human severe acute respiratory syndrome virus
VRSNNMQTLLSKIMSRKQTRPSYCKRAI

SEQ ID NO: 1555 - protein, 60 aa, Human severe acute respiratory syndrome virus
LNVIITLLLHGTIGCLVECTCYTTTMFQVYVSSIYNHHRISTLCLLNDVNTFNGNIVSKF

SEQ ID NO: 1556 - protein, 20 aa, Human severe acute respiratory syndrome virus
ITSKLINWFFRCRFWFWLNL

SEQ ID NO: 1557 - protein, 21 aa, Human severe acute respiratory syndrome virus
LLSSIIQPVFLFFFLNSNCFS

SEQ ID NO: 1558 - protein, 47 aa, Human severe acute respiratory syndrome virus
GTKFQRETLIIILCTVLMFTGFINFFFLTLCIVLFFLIWRVKGTIHT

SEQ ID NO: 1559 - protein, 9 aa, Human severe acute respiratory syndrome virus
KVFFTSIIK

SEQ ID NO: 1560 - protein, 23 aa, Human severe acute respiratory syndrome virus
VECSYTPLIKINTHVGKEIRNWL

SEQ ID NO: 1561 - protein, 68 aa, Human severe acute respiratory syndrome virus
SLHNSLCYNTCKLSNFGTGFNSVDRALFIKHFVNTFIKLKCDSHILVTLNFPNSIFSKGYTFNWCTPF

SEQ ID NO: 1562 - protein, 8 aa, Human severe acute respiratory syndrome virus
AKDIVCSQ

SEQ ID NO: 1563 - protein, 14 aa, Human severe acute respiratory syndrome virus
TRRQCAVLFFVLNL

SEQ ID NO: 1564 - protein, 44 aa, Human severe acute respiratory syndrome virus
EHEAIYTDWCADDSSICEAINGRLECFEFTVLENNLLRGKYCVM

SEQ ID NO: 1565 - protein, 16 aa, Human severe acute respiratory syndrome virus
ITFKKGYFFWCLKRHE

SEQ ID NO: 1566 - protein, 23 aa, Human severe acute respiratory syndrome virus
LQLLLATYTLTVKSLALSDEDFT

SEQ ID NO: 1567 - protein, 33 aa, Human severe acute respiratory syndrome virus
SQLCASDSDLINAHFECLVNNINEAFYTILDVI

SEQ ID NO: 1568 - protein, 79 aa, Human severe acute respiratory syndrome virus
SNLYLTLDDVKNTCNEKFENLPSILEKFNSCTKFRLNPFKDRPEFFNSSAQKIRQPLRSLLYKTTSYICHNNDTVGEQV

SEQ ID NO: 1569 - protein, 9 aa, Human severe acute respiratory syndrome virus
SINHGVDKT

SEQ ID NO: 1570 - protein, 18 aa, Human severe acute respiratory syndrome virus
LFRNTIKYGDSCSLQIRN

SEQ ID NO: 1571 - protein, 11 aa, Human severe acute respiratory syndrome virus
VVCCIKCARKN

SEQ ID NO: 1572 - protein, 7 aa, Human severe acute respiratory syndrome virus
SDNTSSL

SEQ ID NO: 1573 - protein, 7 aa, Human severe acute respiratory syndrome virus
GKTTQWC

SEQ ID NO: 1574 - protein, 94 aa, Human severe acute respiratory syndrome virus
SLLSNVPSTFYGLSLGNFIVTAGLNNGFERLVIKTLYSVNKGTCRSRERCQNDGNLFIQMKIANNVNVNTFTTQYLKEILIQGLHIVTSNASMA

SEQ ID NO: 1575 - protein, 41 aa, Human severe acute respiratory syndrome virus
ANISTSTRNPVGTLIIAANIGKHTASKTSSPTSLAESSFNV

SEQ ID NO: 1576 - protein, 30 aa, Human severe acute respiratory syndrome virus
VVVIICNTMLRSNLWVLTGRTWHFHYSISR

SEQ ID NO: 1577 - protein, 10 aa, Human severe acute respiratory syndrome virus
VPTCSRSFNN

SEQ ID NO: 1578 - protein, 18 aa, Human severe acute respiratory syndrome virus
IFSATMFTSGFQKVARLP

SEQ ID NO: 1579 - protein, 50 aa, Human severe acute respiratory syndrome virus
NFIAMITFHQGRQVHIVTLLWRCNRVHRAYTPHETLSLFLFNTWLNDFDF

SEQ ID NO: 1580 - protein, 67 aa, Human severe acute respiratory syndrome virus
VKRKHKLWAFPFESVKFLGTLNFEGCLVLVALIRALSEPGNFMLMVTAAVDTSLRLDVIKLFGKSAH

SEQ ID NO: 1581 - protein, 65 aa, Human severe acute respiratory syndrome virus
LARACEKIFDAIKRVPIWATEIVVDIASDCTSIELTSEFTECTTAMLSVPVLFIIFNGISAKLVT

SEQ ID NO: 1582 - protein, 4 aa, Human severe acute respiratory syndrome virus
VIRL

SEQ ID NO: 1583 - protein, 62 aa, Human severe acute respiratory syndrome virus
IDAIAMTTGSLITVLTKKNIAVCNWGFAHMWHEYSQCYTATTVLNAVHFCNQLNDLVAVIGA

SEQ ID NO: 1584 - protein, 23 aa, Human severe acute respiratory syndrome virus
GIRTFNEHIGLFKLGQYAFFQLY

SEQ ID NO: 1585 - protein, 13 aa, Human severe acute respiratory syndrome virus
TTSAIFEVFTCLR

SEQ ID NO: 1586 - protein, 11 aa, Human severe acute respiratory syndrome virus
GLFHRVPEATH

SEQ ID NO: 1587 - protein, 36 aa, Human severe acute respiratory syndrome virus
HVSNLKDRQTELDVCFLVDTKNKALHLTFRSHPDET

SEQ ID NO: 1588 - protein, 8 aa, Human severe acute respiratory syndrome virus
STATRTKP

SEQ ID NO: 1589 - protein, 58 aa, Human severe acute respiratory syndrome virus
AVCRRGTSYSFLVNDSKIYYCLYCVGALGMQPSDSYTDFKVRLENRSTRDRGWLAFPG

SEQ ID NO: 1590 - DNA, 29742 bp, Human severe acute respiratory syndrome virus; identical to SEQ ID NO: 1108
  CDS (2)..(29740)

SEQ ID NO: 1591 - protein, 8 aa, Human severe acute respiratory syndrome virus
FFFFLSFS

SEQ ID NO: 1592 - protein, 8 aa, Human severe acute respiratory syndrome virus
EAIKITWG

SEQ ID NO: 1593 - protein, 13 aa, Human severe acute respiratory syndrome virus
FYTLGLFHIGSSP

SEQ ID NO: 1594 - protein, 14 aa, Human severe acute respiratory syndrome virus
HYSLYPRSYSAWPR

SEQ ID NO: 1595 - protein, 15 aa, Human severe acute respiratory syndrome virus
KCGGSFKSSLMLHID

SEQ ID NO: 1596 - protein, 9 aa, Human severe acute respiratory syndrome virus
RLLCEIKVN

SEQ ID NO: 1597 - protein, 15 aa, Human severe acute respiratory syndrome virus
TYLCCLVTRIHSAQE

SEQ ID NO: 1598 - protein, 26 aa, Human severe acute respiratory syndrome virus
TMYRKRNCENVYIAHLPCVVIMSVYA

SEQ ID NO: 1599 - protein, 11 aa, Human severe acute respiratory syndrome virus
VESAEAPLMEF

SEQ ID NO: 1600 - protein, 27 aa, Human severe acute respiratory syndrome virus
SCLEKSSMSAAGRRVTVGCFFCLCGKG

SEQ ID NO: 1601 - protein, 45 aa, Human severe acute respiratory syndrome virus
ASSVFFFLSFLGSVGGNVLYASMCLFSSMTLSLNCGSLSSNLMAP

SEQ ID NO: 1602 - protein, 34 aa, Human severe acute respiratory syndrome virus
VSHVPEGVTSMPMRDIPKNAEALGANCAICGQCL

SEQ ID NO: 1603 - protein, 25 aa, Human severe acute respiratory syndrome virus
SVPCLIRSWSPKFPWVCSGPRLPNA

SEQ ID NO: 1604 - protein, 90 aa, Human severe acute respiratory syndrome virus
VTLYCFVAVRFWRGFLDASAADFLVTVWPCCCWPLPETLLSSWFNLSSSNSARAVSPPPLAIRAGEFPLLLPGVEFLELPRLRDEEREEA

SEQ ID NO: 1605 - protein, 8 aa, Human severe acute respiratory syndrome virus
LPPLLPSA

SEQ ID NO: 1606 - protein, 8 aa, Human severe acute respiratory syndrome virus
KPFGNVVP

SEQ ID NO: 1607 - protein, 39 aa, Human severe acute respiratory syndrome virus
GSCSTVAALLLGLRVPMWSLGVFKAPSVATHTMPSLLAP

SEQ ID NO: 1608 - protein, 10 aa, Human severe acute respiratory syndrome virus
GSEASGPVPR

SEQ ID NO: 1609 - protein, 23 aa, Human severe acute respiratory syndrome virus
KYHLGLSSFILPSPPRTRRVALR

SEQ ID NO: 1610 - protein, 27 aa, Human severe acute respiratory syndrome virus
PIWSSGPLLVLIGTPWPRGNLSSSLPC

SEQ ID NO: 1611 - protein, 64 aa, Human severe acute respiratory syndrome virus
VRAVNQDAVLLGKPWGRRCFGLAPLRPPFWLLSVESVGPPNVMRGALRWFDWGPLSDILICSFI

SEQ ID NO: 1612 - protein, 50 aa, Human severe acute respiratory syndrome virus
NNKYVSKCSSLVTFMKVPTPSYKRTTSWILTVDSNIRCACLNHSVPSMKR

SEQ ID NO: 1613 - protein, 26 aa, Human severe acute respiratory syndrome virus
STKPSSAISITPSVVPYKDLQAHEVY

SEQ ID NO: 1614 - protein, 20 aa, Human severe acute respiratory syndrome virus
MHSAVLQCICNCIEKYKSKQ

SEQ ID NO: 1615 - protein, 24 aa, Human severe acute respiratory syndrome virus
EVSCSFRLWYKVLLDPGFRVKTKI

SEQ ID NO: 1616 - protein, 20 aa, Human severe acute respiratory syndrome virus
ALLKQGIAERLKSTNRSQLK

SEQ ID NO: 1617 - protein, 14 aa, Human severe acute respiratory syndrome virus
AHSFCLSLNGEAKY

SEQ ID NO: 1618 - protein, 24 aa, Human severe acute respiratory syndrome virus
SSNNEKKWRVELLLNLLLSDEKFW

SEQ ID NO: 1619 - protein, 24 aa, Human severe acute respiratory syndrome virus
SCTQLIGMSSTVSTSKSKVCASAS

SEQ ID NO: 1620 - protein, 11 aa, Human severe acute respiratory syndrome virus
CKFIVSKRVKW

SEQ ID NO: 1621 - protein, 6 aa, Human severe acute respiratory syndrome virus
IALVCS

SEQ ID NO: 1622 - protein, 5 aa, Human severe acute respiratory syndrome virus
WARFF

SEQ ID NO: 1623 - protein, 12 aa, Human severe acute respiratory syndrome virus
YSRTSNTLLIVI

SEQ ID NO: 1624 - protein, 25 aa, Human severe acute respiratory syndrome virus
LARCKYNQCQEENNFHVRFMDNLTP

SEQ ID NO: 1625 - protein, 11 aa, Human severe acute respiratory syndrome virus
VLHHLTPNNSS

SEQ ID NO: 1626 - protein, 9 aa, Human severe acute respiratory syndrome virus
IIVSLLNLL

SEQ ID NO: 1627 - protein, 5 aa, Human severe acute respiratory syndrome virus
RQDSK

SEQ ID NO: 1628 - protein, 6 aa, Human severe acute respiratory syndrome virus
SISLLL

SEQ ID NO: 1629 - protein, 31 aa, Human severe acute respiratory syndrome virus
PGSQQDETSVVTYCTSKAILSLLPAWSVFNL

SEQ ID NO: 1630 - protein, 4 aa, Human severe acute respiratory syndrome virus
FPIR

SEQ ID NO: 1631 - protein, 19 aa, Human severe acute respiratory syndrome virus
RLYAAKPESVPTRCDAPNL

SEQ ID NO: 1632 - protein, 29 aa, Human severe acute respiratory syndrome virus
ESVRDVATVISFGRSLMSQRPRECPAIRK

SEQ ID NO: 1633 - protein, 52 aa, Human severe acute respiratory syndrome virus
PRMITAPMTSSLSMSGLVTIVPRRGTLRRMFVSGLNDHIERVRANSLKEATK

SEQ ID NO: 1634 - protein, 23 aa, Human severe acute respiratory syndrome virus
LSHIKPTIQAIAIAIPPVTQLIL

SEQ ID NO: 1635 - protein, 31 aa, Human severe acute respiratory syndrome virus
TTASTKQASVTGHKSQRKTSFIMYKNLFRLE

SEQ ID NO: 1636 - protein, 68 aa, Human severe acute respiratory syndrome virus
ANCSNIIQARNRKPITRFHCSRSCLSSSTVIVPLSAMISNVKVPNRIIIIVSSFRPEDQELLQKSSDF

SEQ ID NO: 1637 - protein, 14 aa, Human severe acute respiratory syndrome virus
HASRRKPLVLLNSR

SEQ ID NO: 1638 - protein, 12 aa, Human severe acute respiratory syndrome virus
QYCSSTHTIEAQ

SEQ ID NO: 1639 - protein, 4 aa, Human severe acute respiratory syndrome virus
GWLV

SEQ ID NO: 1640 - protein, 14 aa, Human severe acute respiratory syndrome virus
LARIPRKQEKEVRY

SEQ ID NO: 1641 - protein, 13 aa, Human severe acute respiratory syndrome virus
LLTYLFLPKRMST

SEQ ID NO: 1642 - protein, 12 aa, Human severe acute respiratory syndrome virus
VRTHFLVLTKAR

SEQ ID NO: 1643 - protein, 13 aa, Human severe acute respiratory syndrome virus
SSSAHHKLDPLLD

SEQ ID NO: 1644 - protein, 17 aa, Human severe acute respiratory syndrome virus
QLLKSRRLCVFAHSVGL

SEQ ID NO: 1645 - protein, 7 aa, Human severe acute respiratory syndrome virus
HFQYQCL

SEQ ID NO: 1646 - protein, 8 aa, Human severe acute respiratory syndrome virus
TQAGSKLR

SEQ ID NO: 1647 - protein, 9 aa, Human severe acute respiratory syndrome virus
NSHVQRHSL

SEQ ID NO: 1648 - protein, 16 aa, Human severe acute respiratory syndrome virus
HLSAYPQNNHQFGSLL

SEQ ID NO: 1649 - protein, 10 aa, Human severe acute respiratory syndrome virus
VLVLKCRHLQ

SEQ ID NO: 1650 - protein, 5 aa, Human severe acute respiratory syndrome virus
RQLYL

SEQ ID NO: 1651 - protein, 38 aa, Human severe acute respiratory syndrome virus
HCYMVYSSHSYVCASKQSSWHHKVMGSWICTSNKANIS

SEQ ID NO: 1652 - protein, 4 aa, Human severe acute respiratory syndrome virus
FYMR

SEQ ID NO: 1653 - protein, 29 aa, Human severe acute respiratory syndrome virus
CIVENISRHRGTKIAPPYLQRQAKDVNRW

SEQ ID NO: 1654 - protein, 8 aa, Human severe acute respiratory syndrome virus
QIAAVNCK

SEQ ID NO: 1655 - protein, 13 aa, Human severe acute respiratory syndrome virus
TGSPYKGLAAIFY

SEQ ID NO: 1656 - protein, 5 aa, Human severe acute respiratory syndrome virus
AQLFW

SEQ ID NO: 1657 - protein, 11 aa, Human severe acute respiratory syndrome virus
RSEKQQEMQRQ

SEQ ID NO: 1658 - protein, 15 aa, Human severe acute respiratory syndrome virus
QAIRKGVRLVAVSLL

SEQ ID NO: 1659 - protein, 17 aa, Human severe acute respiratory syndrome virus
HEQYLQEKHCQFLLAVQ

SEQ ID NO: 1660 - protein, 4 aa, Human severe acute respiratory syndrome virus
LIQE

SEQ ID NO: 1661 - protein, 6 aa, Human severe acute respiratory syndrome virus
VRLCVM

SEQ ID NO: 1662 - protein, 45 aa, Human severe acute respiratory syndrome virus
FDTLENWLRVILIKLAARTTRACTLEATATTSHATKQDCNHDDGN

SEQ ID NO: 1663 - protein, 27 aa, Human severe acute respiratory syndrome virus
SSNEAEPNIPRPFNILLIFSQFLKVNE

SEQ ID NO: 1664 - protein, 22 aa, Human severe acute respiratory syndrome virus
IFSDLIEAVNFFLNVDDRSVNA

SEQ ID NO: 1665 - protein, 8 aa, Human severe acute respiratory syndrome virus
NVAKINIW

SEQ ID NO: 1666 - protein, 13 aa, Human severe acute respiratory syndrome virus
CMIFEVLVQLFFE

SEQ ID NO: 1667 - protein, 23 aa, Human severe acute respiratory syndrome virus
VKLRLQRIINCVVNDANNDITIS

SEQ ID NO: 1668 - protein, 59 aa, Human severe acute respiratory syndrome virus
DKCIVCSNYLWRKEVPLCNKPRSAIKHKNTFTREVCFAFMTNCWRCGEVPLLGWHIRDM

SEQ ID NO: 1669 - protein, 25 aa, Human severe acute respiratory syndrome virus
EDNTMRGCLWEGHKVVALSTKVNSF

SEQ ID NO: 1670 - protein, 24 aa, Human severe acute respiratory syndrome virus
LSKNTLRHFSSSKISRSPDFSSPD

SEQ ID NO: 1671 - protein, 15 aa, Human severe acute respiratory syndrome virus
LLCYIGLKALKSACN

SEQ ID NO: 1672 - protein, 18 aa, Human severe acute respiratory syndrome virus
PVNLYLRLDFIKSRKDII

SEQ ID NO: 1673 - protein, 14 aa, Human severe acute respiratory syndrome virus
NCTKIRAKLFNKCV

SEQ ID NO: 1674 - protein, 16 aa, Human severe acute respiratory syndrome virus
CLSILVNNVLQLAQCS

SEQ ID NO: 1675 - protein, 4 aa, Human severe acute respiratory syndrome virus
CCCK

SEQ ID NO: 1676 - protein, 59 aa, Human severe acute respiratory syndrome virus
FLNLTNRLVKLVGDLFLVLIENILGNSNAIEPICHLHSKRYLKSSASTKCPSSSGSTTN

SEQ ID NO: 1677 - protein, 35 aa, Human severe acute respiratory syndrome virus
SSSVGSNHIISEQRWQHCKSIELLRTNEISSINIT

SEQ ID NO: 1678 - protein, 30 aa, Human severe acute respiratory syndrome virus
AFAILLHEASISECHLIKEQVLNKRPLSWL

SEQ ID NO: 1679 - protein, 34 aa, Human severe acute respiratory syndrome virus
KIKTTKIFQSWGFVHLFDLSEHFTCVAILFSSNT

SEQ ID NO: 1680 - protein, 4 aa, Human severe acute respiratory syndrome virus
ECTI

SEQ ID NO: 1681 - protein, 43 aa, Human severe acute respiratory syndrome virus
LCAKATILEKQISTFSRISADVHITIYGGFSHRNRHYFCSNAN

SEQ ID NO: 1682 - protein, 14 aa, Human severe acute respiratory syndrome virus
KVSRYSNGVIRVSN

SEQ ID NO: 1683 - protein, 4 aa, Human severe acute respiratory syndrome virus
TIST

SEQ ID NO: 1684 - protein, 14 aa, Human severe acute respiratory syndrome virus
RHSISHNRFLASTT

SEQ ID NO: 1685 - protein, 67 aa, Human severe acute respiratory syndrome virus
RNCMVTSTNASSNRNVALIRSVDMLSSYKTACLSLEYIVSSRIYAPSWCELICMNCCRNISAVNILI

SEQ ID NO: 1686 - protein, 5 aa, Human severe acute respiratory syndrome virus
NSNFR

SEQ ID NO: 1687 - protein, 16 aa, Human severe acute respiratory syndrome virus
SICSRCNYTYTPKRAR

SEQ ID NO: 1688 - protein, 28 aa, Human severe acute respiratory syndrome virus
YFRCFRISNGISEIRNITAKLLKWLKSL

SEQ ID NO: 1689 - protein, 22 aa, Human severe acute respiratory syndrome virus
HTSTSESIKIKIDTLVLNKVSG

SEQ ID NO: 1690 - protein, 10 aa, Human severe acute respiratory syndrome virus
FWSTNRGRCI

SEQ ID NO: 1691 - protein, 25 aa, Human severe acute respiratory syndrome virus
KFKRKYYNSVRLVANASSGVKTIII

SEQ ID NO: 1692 - protein, 45 aa, Human severe acute respiratory syndrome virus
WPITIKSRWGARFAIRGERHIRYVSLKGPKLAMSKIPIFIIIITS

SEQ ID NO: 1693 - protein, 69 aa, Human severe acute respiratory syndrome virus
SSINVPSIPSKDTTHEIIWQFIIIISNNTSLSWRYLSYIISLDYKRICIDIGEAKIIQLSGRNAIALKG

SEQ ID NO: 1694 - protein, 47 aa, Human severe acute respiratory syndrome virus
VVEHRVISNTIRNFFSLPCIDRREFSSIKNLSKRTQVCNIRESHNIS

SEQ ID NO: 1695 - protein, 52 aa, Human severe acute respiratory syndrome virus
GNNPEIRGLVNSFVNLKALNRAFEFSKWILRTINSICDCTIFIILEHKCSWL

SEQ ID NO: 1696 - protein, 8 aa, Human severe acute respiratory syndrome virus
IANKIGCS

SEQ ID NO: 1697 - protein, 8 aa, Human severe acute respiratory syndrome virus
RAPNVLSR

SEQ ID NO: 1698 - protein, 29 aa, Human severe acute respiratory syndrome virus
KGCKNGSKICNVNTKRQLKNRFQSVKTRR

SEQ ID NO: 1699 - protein, 26 aa, Human severe acute respiratory syndrome virus
ITNYIYRLIALINIEKPIFIFKHKLS

SEQ ID NO: 1700 - protein, 5 aa, Human severe acute respiratory syndrome virus
VFKIT

SEQ ID NO: 1701 - protein, 61 aa, Human severe acute respiratory syndrome virus
NIKRKGIRYVLESAIKCIIEYHSMCLCTHGFRNSKERVVTQFKVTCSYNNISRIVNNNHRL

SEQ ID NO: 1702 - protein, 15 aa, Human severe acute respiratory syndrome virus
LVVHGRTKNPTTDNI

SEQ ID NO: 1703 - protein, 36 aa, Human severe acute respiratory syndrome virus
FLCGSKINTILKRYDRVAKRMINSMKPCNIRIKWKK

SEQ ID NO: 1704 - protein, 4 aa, Human severe acute respiratory syndrome virus
IKSV

SEQ ID NO: 1705 - protein, 13 aa, Human severe acute respiratory syndrome virus
SKNFIRIVNPPHR

SEQ ID NO: 1706 - protein, 28 aa, Human severe acute respiratory syndrome virus
SMLSVIRSLNIIKSGAPVKVTTTSESKK

SEQ ID NO: 1707 - protein, 14 aa, Human severe acute respiratory syndrome virus
ENKHVRLVVNKNIT

SEQ ID NO: 1708 - protein, 36 aa, Human severe acute respiratory syndrome virus
NHNSVVFSNDKPTFFQKRINHIIDLILLKRHYSSSS

SEQ ID NO: 1709 - protein, 10 aa, Human severe acute respiratory syndrome virus
FKRKFAHVKE

SEQ ID NO: 1710 - protein, 36 aa, Human severe acute respiratory syndrome virus
IGRQLDRICVPPENVVSMHGIAINLFLRLAKIVSPN

SEQ ID NO: 1711 - protein, 4 aa, Human severe acute respiratory syndrome virus
KCFR

SEQ ID NO: 1712 - protein, 11 aa, Human severe acute respiratory syndrome virus
CIYICNKSCPP

SEQ ID NO: 1713 - protein, 26 aa, Human severe acute respiratory syndrome virus
EMAHKLVKVSIPRMLCYLYSYRTTQG

SEQ ID NO: 1714 - protein, 49 aa, Human severe acute respiratory syndrome virus
FLLYKSTQISEKPFFRVILFCHMFGPRVIHIANNKVPFISRMYCCTVSN

SEQ ID NO: 1715 - protein, 12 aa, Human severe acute respiratory syndrome virus
SRICVGDEVIKI

SEQ ID NO: 1716 - protein, 34 aa, Human severe acute respiratory syndrome virus
CASWQPLSEHSCTWCNSFIRASTKVNNSHVVGYS

SEQ ID NO: 1717 - protein, 4 aa, Human severe acute respiratory syndrome virus
SKCI

SEQ ID NO: 1718 - protein, 54 aa, Human severe acute respiratory syndrome virus
VLTQLSILCDIHHYSFWYNSIFTIILKVTLFKKHSLHLVQVRHRNTWLPRLTCL

SEQ ID NO: 1719 - protein, 16 aa, Human severe acute respiratory syndrome virus
FWVEGFNMSILTPKHE

SEQ ID NO: 1720 - protein, 12 aa, Human severe acute respiratory syndrome virus
NFSIVNCNLDHF

SEQ ID NO: 1721 - protein, 9 aa, Human severe acute respiratory syndrome virus
LYYLDKVIK

SEQ ID NO: 1722 - protein, 9 aa, Human severe acute respiratory syndrome virus
KINHRTHTF

SEQ ID NO: 1723 - protein, 21 aa, Human severe acute respiratory syndrome virus
TCLRICYEVIFHCAVHRDKIL

SEQ ID NO: 1724 - protein, 42 aa, Human severe acute respiratory syndrome virus
MKTAKLSMTEISINDVFEGIALELISLYEFIHSELEKVSFHL

SEQ ID NO: 1725 - protein, 6 aa, Human severe acute respiratory syndrome virus
SGLKIL

SEQ ID NO: 1726 - protein, 28 aa, Human severe acute respiratory syndrome virus
VSALSKVGFRQLLNNAVYFLKVVKLCFY

SEQ ID NO: 1727 - protein, 12 aa, Human severe acute respiratory syndrome virus
CDSIDASLCWSL

SEQ ID NO: 1728 - protein, 4 aa, Human severe acute respiratory syndrome virus
TFCY

SEQ ID NO: 1729 - protein, 23 aa, Human severe acute respiratory syndrome virus
NTITGVSKKVYLSFHSTIKQDSK

SEQ ID NO: 1730 - protein, 115 aa, Human severe acute respiratory syndrome virus
RTSTLSRFLGNVSHCADTYCRYMCWGFSFVVPDYSISSDINTQIIEYLNLWHWFNVTLSPKLKCNINRKCCLIFKDLHINTIYLCVNSIINDGNRCFAGVSIKVSFINNIISHIF

SEQ ID NO: 1731 - protein, 17 aa, Human severe acute respiratory syndrome virus
PGKCIPQVISIKLFVNP

SEQ ID NO: 1732 - protein, 28 aa, Human severe acute respiratory syndrome virus
AKSSRNHHIICIQVLSVLICMVSANSTT

SEQ ID NO: 1733 - protein, 39 aa, Human severe acute respiratory syndrome virus
IASCNTRSRFEWNIINIRHYLFAMRLTRTIRIVKERQLL

SEQ ID NO: 1734 - protein, 27 aa, Human severe acute respiratory syndrome virus
ISKCTFIESWSVECMLIHIQTTTITAW

SEQ ID NO: 1735 - protein, 126 aa, Human severe acute respiratory syndrome virus
QDSCVKPTHNCIGWVTINVTIPKQTNTISEFIVMCSIRIEEFLYFVSFVTTWLSIVELPFYFSLRHTLDSLWISNVMKNWKLISKQCRLHNHVLYFSASRINPQFISYNRVFNRPINALNKALMDC

SEQ ID NO: 1736 - protein, 58 aa, Human severe acute respiratory syndrome virus
TSSHDSITTSHMCISMYLAMLVMVTLKVTRKAPLLNINHKWVIDIVKTHRMIPAGISI

SEQ ID NO: 1737 - protein, 25 aa, Human severe acute respiratory syndrome virus
SRKASCTFVTQTTRSFRSNLDKVLH

SEQ ID NO: 1738 - protein, 15 aa, Human severe acute respiratory syndrome virus
CKLKAMRPKDEHDSV

SEQ ID NO: 1739 - protein, 60 aa, Human severe acute respiratory syndrome virus
QSFQCITEHLYYLNTHYIPGQAFIHEWYKMFKLVTWWRFCINSGEFCVIFSVNITSRYSY

SEQ ID NO: 1740 - protein, 7 aa, Human severe acute respiratory syndrome virus
VNTCRKS

SEQ ID NO: 1741 - protein, 66 aa, Human severe acute respiratory syndrome virus
VSTHSISSCMTALYIKANPRTNVTNSFFAGDKHIRVTIDLVIHFETHHRDESTVGHVLWYAWYVNT

SEQ ID NO: 1742 - protein, 38 aa, Human severe acute respiratory syndrome virus
SFSLEFYINAEVCRCLCRMKTSNDLTTVLKKSSYIFCL

SEQ ID NO: 1743 - protein, 9 aa, Human severe acute respiratory syndrome virus
CSHIATWYF

SEQ ID NO: 1744 - protein, 53 aa, Human severe acute respiratory syndrome virus
TCKLQFVIKISIRHYAQNANFCPCDSHIEAVDITRVCCFSSLCEYDIVIFRTL

SEQ ID NO: 1745 - protein, 8 aa, Human severe acute respiratory syndrome virus
INSLRRQS

SEQ ID NO: 1746 - protein, 5 aa, Human severe acute respiratory syndrome virus
SYSVL

SEQ ID NO: 1747 - protein, 27 aa, Human severe acute respiratory syndrome virus
DKNSFSPSRIACKKFSYNAYLRSVDCR

SEQ ID NO: 1748 - protein, 16 aa, Human severe acute respiratory syndrome virus
NIMCNNTFVEHFEALS

SEQ ID NO: 1749 - protein, 6 aa, Human severe acute respiratory syndrome virus
LILVCF

SEQ ID NO: 1750 - protein, 5 aa, Human severe acute respiratory syndrome virus
LIVIN

SEQ ID NO: 1751 - protein, 30 aa, Human severe acute respiratory syndrome virus
STHSVNNFSRTTATSSKEHVWTYCFHKSAH

SEQ ID NO: 1752 - protein, 6 aa, Human severe acute respiratory syndrome virus
IKIFWF

SEQ ID NO: 1753 - protein, 11 aa, Human severe acute respiratory syndrome virus
CAFSQQCAGGW

SEQ ID NO: 1754 - protein, 52 aa, Human severe acute respiratory syndrome virus
LSRIANIDVVFCTKSSIDNTQVIISSHRDFIKDYNVSSCFWQCIYSAENILF

SEQ ID NO: 1755 - protein, 27 aa, Human severe acute respiratory syndrome virus
IHFEFIKTLYARTRRYDSTTFIYGQIF

SEQ ID NO: 1756 - protein, 4 aa, Human severe acute respiratory syndrome virus
CLFT

SEQ ID NO: 1757 - protein, 57 aa, Human severe acute respiratory syndrome virus
GINSCMRACRIHYASRWVIESKSDGKMTLTSTRWSLECRVLLHADLLIICNIARKLI

SEQ ID NO: 1758 - protein, 18 aa, Human severe acute respiratory syndrome virus
DVECWVQASNSHIVLLWH

SEQ ID NO: 1759 - protein, 73 aa, Human severe acute respiratory syndrome virus
SRCTKWHYSVRCQHKVITNIQLVCRSTSVHNSITIVTFFKGVLSNLYFTIFSYTVTSKDIVSVQWWSRFSNLP

SEQ ID NO: 1760 - protein, 17 aa, Human severe acute respiratory syndrome virus
KMQFSVREYFAYSGNTI

SEQ ID NO: 1761 - protein, 55 aa, Human severe acute respiratory syndrome virus
QLKCFLSGFERFCCEKLESLSTSVGKYVIASISPITCCYRIEVSDIVTAYTCVFV

SEQ ID NO: 1762 - protein, 8 aa, Human severe acute respiratory syndrome virus
TKNLTIST

SEQ ID NO: 1763 - protein, 8 aa, Human severe acute respiratory syndrome virus
WKTNGRLM

SEQ ID NO: 1764 - protein, 8 aa, Human severe acute respiratory syndrome virus
LAIIAHTS

SEQ ID NO: 1765 - protein, 23 aa, Human severe acute respiratory syndrome virus
IQLCHISDITTWGIANIGINRQH

SEQ ID NO: 1766 - protein, 10 aa, Human severe acute respiratory syndrome virus
NDMVIAALAT

SEQ ID NO: 1767 - protein, 11 aa, Human severe acute respiratory syndrome virus
EWSPNTGTATK

SEQ ID NO: 1768 - protein, 28 aa, Human severe acute respiratory syndrome virus
IAQYTSTYSLQDCMWCVHSLIKLRFPVP

SEQ ID NO: 1769 - protein, 5 aa, Human severe acute respiratory syndrome virus
GVIIS

SEQ ID NO: 1770 - protein, 15 aa, Human severe acute respiratory syndrome virus
HYGIHVQHVASKLIM

SEQ ID NO: 1771 - protein, 5 aa, Human severe acute respiratory syndrome virus
LSNVL

SEQ ID NO: 1772 - protein, 23 aa, Human severe acute respiratory syndrome virus
IQVKDISILLIRMFCKWVSINSQ

SEQ ID NO: 1773 - protein, 22 aa, Human severe acute respiratory syndrome virus
HEPFNHKCTICFDNIIDKTACA

SEQ ID NO: 1774 - protein, 15 aa, Human severe acute respiratory syndrome virus
WIWVRQVHVIISLFN

SEQ ID NO: 1775 - protein, 4 aa, Human severe acute respiratory syndrome virus
HCML

SEQ ID NO: 1776 - protein, 38 aa, Human severe acute respiratory syndrome virus
AKFVRSFSKVSLSPTFCLRHEHIILIIKNCLKVLNASY

SEQ ID NO: 1777 - protein, 51 aa, Human severe acute respiratory syndrome virus
TLSRIVTVIAHNGIIRKNHHGEMFTQVSVKLIHEFMINIPISIETLIEPVL

SEQ ID NO: 1778 - protein, 13 aa, Human severe acute respiratory syndrome virus
IADILVSYLITIS

SEQ ID NO: 1779 - protein, 27 aa, Human severe acute respiratory syndrome virus
KKCIYIGCNSLTNVKDTISISSCSITG

SEQ ID NO: 1780 - protein, 7 aa, Human severe acute respiratory syndrome virus
CSTWFNI

SEQ ID NO: 1781 - protein, 8 aa, Human severe acute respiratory syndrome virus
AATHDHLT

SEQ ID NO: 1782 - protein, 7 aa, Human severe acute respiratory syndrome virus
YLRTLVS

SEQ ID NO: 1783 - protein, 5 aa, Human severe acute respiratory syndrome virus
PVETV

SEQ ID NO: 1784 - protein, 45 aa, Human severe acute respiratory syndrome virus
VTASVMFASKNKRGHYPKHVRHGSVTFWIIPTHKVWSFYITVNSF

SEQ ID NO: 1785 - protein, 23 aa, Human severe acute respiratory syndrome virus
HIMPATVKLACSNYHSSSSSGGY

SEQ ID NO: 1786 - protein, 56 aa, Human severe acute respiratory syndrome virus
FLMKLSICHSTTDRDTSYGASSILCTNGILKIHLSYSRDDITLSIREKCILILITH

SEQ ID NO: 1787 - protein, 16 aa, Human severe acute respiratory syndrome virus
VIIKSSLTPFIKWETS

SEQ ID NO: 1788 - protein, 30 aa, Human severe acute respiratory syndrome virus
FIQIVNDYLVGINTATIVTIKVFINNFNYE

SEQ ID NO: 1789 - protein, 32 aa, Human severe acute respiratory syndrome virus
ELSDITHCWQIITIIVIITDSSVAILSKEEVF

SEQ ID NO: 1790 - protein, 35 aa, Human severe acute respiratory syndrome virus
FNRTSFLKETFRHSKVIKVFIKITGFDSLKSNIVC

SEQ ID NO: 1791 - protein, 7 aa, Human severe acute respiratory syndrome virus
KACSAFI

SEQ ID NO: 1792 - protein, 14 aa, Human severe acute respiratory syndrome virus
IARSCMHSWISSIH

SEQ ID NO: 1793 - protein, 10 aa, Human severe acute respiratory syndrome virus
KFLETETRAM

SEQ ID NO: 1794 - protein, 9 aa, Human severe acute respiratory syndrome virus
VYILIMYDS

SEQ ID NO: 1795 - protein, 7 aa, Human severe acute respiratory syndrome virus
LTKMVSS

SEQ ID NO: 1796 - protein, 13 aa, Human severe acute respiratory syndrome virus
NNKRNTIYKYFSY

SEQ ID NO: 1797 - protein, 12 aa, Human severe acute respiratory syndrome virus
WSKTCRWKHSRK

SEQ ID NO: 1798 - protein, 76 aa, Human severe acute respiratory syndrome virus
HIKVCTMKDTPIIQTVNTIGMVCLVPIFKITVEETKSLFRKIIFQQIPLNKWFCEISIHMGLSSQCPSQSEDGHQQ

SEQ ID NO: 1799 - protein, 28 aa, Human severe acute respiratory syndrome virus
IHNRNSAAWCYLYEITEIVPVPIKILII

SEQ ID NO: 1800 - protein, 19 aa, Human severe acute respiratory syndrome virus
CQYAYNACITHSIAELYSL

SEQ ID NO: 1801 - protein, 6 aa, Human severe acute respiratory syndrome virus
LAYTLT

SEQ ID NO: 1802 - protein, 5 aa, Human severe acute respiratory syndrome virus
VSIYA

SEQ ID NO: 1803 - protein, 29 aa, Human severe acute respiratory syndrome virus
DVRILYEVIPILLIEIIIITAIVCDEYFF

SEQ ID NO: 1804 - protein, 10 aa, Human severe acute respiratory syndrome virus
CITITLIKMT

SEQ ID NO: 1805 - protein, 7 aa, Human severe acute respiratory syndrome virus
ISHCVFS

SEQ ID NO: 1806 - protein, 48 aa, Human severe acute respiratory syndrome virus
YMWYHVTIYSKLEKVMDSNRWTIFNQVINSLFMLVVRHSMPLNYKVRV

SEQ ID NO: 1807 - protein, 15 aa, Human severe acute respiratory syndrome virus
IAFLILLLEATAISF

SEQ ID NO: 1808 - protein, 61 aa, Human severe acute respiratory syndrome virus
ELCKTSTFFVVNIKSPVDDISTSACAARCKTGCTYTANPFKNVDASADCIKGSRSWSQLQP

SEQ ID NO: 1809 - protein, 95 aa, Human severe acute respiratory syndrome virus
PFHIPQTVQTVFLSVKPTGSLAQVVGIWTYLPFKSQNPLGFGWSMWHLQYRQHEAPPKDSWSMLASGVTVIACPVPVCVHNIFTQLVIGCPPLAR

SEQ ID NO: 1810 - protein, 29 aa, Human severe acute respiratory syndrome virus
SLYALAGSTAKAQKESTVELAGTSVAFPA

SEQ ID NO: 1811 - protein, 46 aa, Human severe acute respiratory syndrome virus
RRTVAAKLPSTIPLFRLFKPLMKYKYFTLGPFGVSVTNLQGGSSSV

SEQ ID NO: 1812 - protein, 33 aa, Human severe acute respiratory syndrome virus
IVPVPSLLGNLAHLRSWWSDSNASTNLPPFELL

SEQ ID NO: 1813 - protein, 60 aa, Human severe acute respiratory syndrome virus
ASALSSVQAVCVVPAAQDICRSATGLSSLFCSLTAELALRAVTIRGQAKFGELSMLISLS

SEQ ID NO: 1814 - protein, 29 aa, Human severe acute respiratory syndrome virus
TILLSASTTCWISQSADAYVKVLPSQVFL

SEQ ID NO: 1815 - protein, 69 aa, Human severe acute respiratory syndrome virus
SGTTTMSLAAVVNGMMLSGTQPSRALLIMLLSASLSSFLSIVKSIVCIALVTFALLSSDLACLYIWVIA

SEQ ID NO: 1816 - protein, 42 aa, Human severe acute respiratory syndrome virus
SAIFSNLRCMAASRSNSDLATFKDFFNFLRTTSESPLATACS

SEQ ID NO: 1817 - protein, 6 aa, Human severe acute respiratory syndrome virus
ASWAVA

SEQ ID NO: 1818 - protein, 14 aa, Human severe acute respiratory syndrome virus
AAYDGKELNSEAIA

SEQ ID NO: 1819 - protein, 64 aa, Human severe acute respiratory syndrome virus
RVARLSSISSHNLLMSTAPCMDSKTDKRETIFSKASVVSFARRISLWSCTHCAHNLEDDSTLSC

SEQ ID NO: 1820 - protein, 63 aa, Human severe acute respiratory syndrome virus
RTESSTTDVHFTSDILDCTVATLIHGLPPIPNNLMLSLKASILLLGGKSPWEFIYLNSCVETK

SEQ ID NO: 1821 - protein, 7 aa, Human severe acute respiratory syndrome virus
TPRVSLK

SEQ ID NO: 1822 - protein, 9 aa, Human severe acute respiratory syndrome virus
RLSKQKRPK

SEQ ID NO: 1823 - protein, 4 aa, Human severe acute respiratory syndrome virus
QQQQ

SEQ ID NO: 1824 - protein, 4 aa, Human severe acute respiratory syndrome virus
PKKQ

SEQ ID NO: 1825 - protein, 16 aa, Human severe acute respiratory syndrome virus
TSMIHCKVLPVINNNG

SEQ ID NO: 1826 - protein, 21 aa, Human severe acute respiratory syndrome virus
YSTHTNTIALAKNMIVVTTPE

SEQ ID NO: 1827 - protein, 14 aa, Human severe acute respiratory syndrome virus
LEVTEITKAHMEIA

SEQ ID NO: 1828 - protein, 5 aa, Human severe acute respiratory syndrome virus
SKALP

SEQ ID NO: 1829 - protein, 17 aa, Human severe acute respiratory syndrome virus
TSVMTFISVQTRLAASS

SEQ ID NO: 1830 - protein, 23 aa, Human severe acute respiratory syndrome virus
TVRAVMRISKTKAEAYITQSLSL

SEQ ID NO: 1831 - protein, 22 aa, Human severe acute respiratory syndrome virus
PDKLVSANSSHVMIRITQLAGM

SEQ ID NO: 1832 - protein, 4 aa, Human severe acute respiratory syndrome virus
TILK

SEQ ID NO: 1833 - protein, 41 aa, Human severe acute respiratory syndrome virus
ATVAREGNRNKHKNACLCLTSSIAHAAIAIIPRVNGKKAFS

SEQ ID NO: 1834 - protein, 10 aa, Human severe acute respiratory syndrome virus
TKKNSDHCVL

SEQ ID NO: 1835 - protein, 14 aa, Human severe acute respiratory syndrome virus
TRINSDVKKVKSIQ

SEQ ID NO: 1836 - protein, 60 aa, Human severe acute respiratory syndrome virus
VPLTIFLNLPWKVTPEHCLTTSNGVNSSSKIVLPRIVRPFIPFCSSSFKAAHISKTAIPV

SEQ ID NO: 1837 - protein, 9 aa, Human severe acute respiratory syndrome virus
AERGPNMST

SEQ ID NO: 1838 - protein, 6 aa, Human severe acute respiratory syndrome virus
SCVKGS

SEQ ID NO: 1839 - protein, 56 aa, Human severe acute respiratory syndrome virus
LYFIATRLKSFKVVVNLLRNHLSPLITAAYSHAKTFNVMVVSVPAACAVCLSTNGP

SEQ ID NO: 1840 - protein, 17 aa, Human severe acute respiratory syndrome virus
NLPSKSVPACTPVGSSI

SEQ ID NO: 1841 - protein, 6 aa, Human severe acute respiratory syndrome virus
QKDTQS

SEQ ID NO: 1842 - protein, 19 aa, Human severe acute respiratory syndrome virus
SMLKPTLPHDPLRKEPLMV

SEQ ID NO: 1843 - protein, 6 aa, Human severe acute respiratory syndrome virus
LGLMAH

SEQ ID NO: 1844 - protein, 7 aa, Human severe acute respiratory syndrome virus
TPDGEPL

SEQ ID NO: 1845 - protein, 7 aa, Human severe acute respiratory syndrome virus
HARTENV

SEQ ID NO: 1846 - protein, 35 aa, Human severe acute respiratory syndrome virus
PGWIRTNLYLGVLGLEVSTLSLSRQFCIEWPITRS

SEQ ID NO: 1847 - protein, 4 aa, Human severe acute respiratory syndrome virus
TLPA

SEQ ID NO: 1848 - protein, 14 aa, Human severe acute respiratory syndrome virus
TRKLWLDLRMSRSS

SEQ ID NO: 1849 - protein, 66 aa, Human severe acute respiratory syndrome virus
LGLSMSSAVQMTCLGQYTVSSNHNPLRVVVPQVTCTMHPSTLPDGNAIFLKPLCRTAEVIDVCGGW

SEQ ID NO: 1850 - protein, 23 aa, Human severe acute respiratory syndrome virus
RTSAPELLKSFRAFAKWQQAASR

SEQ ID NO: 1851 - protein, 65 aa, Human severe acute respiratory syndrome virus
LVVSKAPLKYLYLLYRARYLLYCVSGNSVSLRNFRYISLLSKKVHKAASSKVLNVTPLNMTLFLR

SEQ ID NO: 1852 - protein, 15 aa, Human severe acute respiratory syndrome virus
LLKNQWQCFREIQNT

SEQ ID NO: 1853 - protein, 16 aa, Human severe acute respiratory syndrome virus
IAVIQKGTIGENMANH

SEQ ID NO: 1854 - protein, 9 aa, Human severe acute respiratory syndrome virus
AKNETSLVK

SEQ ID NO: 1855 - protein, 5 aa, Human severe acute respiratory syndrome virus
NVKYK

SEQ ID NO: 1856 - protein, 6 aa, Human severe acute respiratory syndrome virus
TPGRKL

SEQ ID NO: 1857 - protein, 34 aa, Human severe acute respiratory syndrome virus
AGTRQSIVKDIKNKSALAATTWLYSPKTRLNFIK

SEQ ID NO: 1858 - protein, 50 aa, Human severe acute respiratory syndrome virus
AAQVTNMAIIPPATTEADTSKAPTGCTRGVKMLAMRFIASTPQKTPDRAL

SEQ ID NO: 1859 - protein, 42 aa, Human severe acute respiratory syndrome virus
CSLLRTHLPLVDRQIPTSDLSHVPCLQYSASKVVTTLTEPSR

SEQ ID NO: 1860 - protein, 13 aa, Human severe acute respiratory syndrome virus
VLGNCMMEPSIST

SEQ ID NO: 1861 - protein, 8 aa, Human severe acute respiratory syndrome virus
RVSGRSSL

SEQ ID NO: 1862 - protein, 10 aa, Human severe acute respiratory syndrome virus
EIEPSSKLVS

SEQ ID NO: 1863 - protein, 36 aa, Human severe acute respiratory syndrome virus
QYGTGLPIASLKIVHSAARTQAEVAKSLYSMSLEGV

SEQ ID NO: 1864 - protein, 83 aa, Human severe acute respiratory syndrome virus
QMLPTALKTRGRKCKKSPLIALSTVPGKPGTMKPISLVMIAATTGQLLSFLYEPPRWLNHASKPACLFAKQSSVEMMSRVTPS

SEQ ID NO: 1865 - protein, 6 aa, Human severe acute respiratory syndrome virus
PMISFV

SEQ ID NO: 1866 - protein, 13 aa, Human severe acute respiratory syndrome virus
PSWIDNVCTGITI

SEQ ID NO: 1867 - protein, 69 aa, Human severe acute respiratory syndrome virus
QTNAARTHNNVALSISLKQVLTILPPLSEILVVMTLTTCLVVAQVSVKGMLFFLAAVRICLRSCSDKDM

SEQ ID NO: 1868 - protein, 10 aa, Human severe acute respiratory syndrome virus
SFTFQMSETL

SEQ ID NO: 1869 - protein, 29 aa, Human severe acute respiratory syndrome virus
LFATWALICLALQSIHAPRSLGVMFSTLL

SEQ ID NO: 1870 - protein, 16 aa, Human severe acute respiratory syndrome virus
VSMKLLQLSPVTSKSE

SEQ ID NO: 1871 - protein, 42 aa, Human severe acute respiratory syndrome virus
CESLRHSITSFVSTSVSTTPCRAADTNVERTPSKATPFANSL

SEQ ID NO: 1872 - protein, 22 aa, Human severe acute respiratory syndrome virus
AVATSALSFSIGTLKVAEKVST

SEQ ID NO: 1873 - protein, 30 aa, Human severe acute respiratory syndrome virus
ASNILTETSVLSPTFDTRAWSSNRIGWHIS

SEQ ID NO: 1874 - protein, 47 aa, Human severe acute respiratory syndrome virus
YTEADLEADSSHLDLPSKTMTLIGSEPLVLLALKLSKLTKWESGCLS

SEQ ID NO: 1875 - protein, 5 aa, Human severe acute respiratory syndrome virus
PALSK

SEQ ID NO: 1876 - protein, 53 aa, Human severe acute respiratory syndrome virus
SAPFFTATLSTIYDDWSVGLIGLLNWSDKSRATSSLMNVLPVQNVSQLRQFQL

SEQ ID NO: 1877 - protein, 10 aa, Human severe acute respiratory syndrome virus
VLQKPRPPFA

SEQ ID NO: 1878 - protein, 21 aa, Human severe acute respiratory syndrome virus
KDLFMPLTIVVHSTRVARLRL

SEQ ID NO: 1879 - protein, 13 aa, Human severe acute respiratory syndrome virus
HIMQVEEVQPSMI

SEQ ID NO: 1880 - protein, 4 aa, Human severe acute respiratory syndrome virus
LFHM

SEQ ID NO: 1881 - protein, 33 aa, Human severe acute respiratory syndrome virus
KEAKKMYILTIAETGAICTILMINHMSQELLMK

SEQ ID NO: 1882 - protein, 13 aa, Human severe acute respiratory syndrome virus
PKNTCIIAERPNK

SEQ ID NO: 1883 - protein, 30 aa, Human severe acute respiratory syndrome virus
KNFVNNIYAKTHSAARPKIVKSSLYDEIVT

SEQ ID NO: 1884 - protein, 6 aa, Human severe acute respiratory syndrome virus
MVSRAG

SEQ ID NO: 1885 - protein, 38 aa, Human severe acute respiratory syndrome virus
ESRESNPLKQMLQGKEPSQKSIVVTLDELRYNSLTPLQ

SEQ ID NO: 1886 - protein, 44 aa, Human severe acute respiratory syndrome virus
EGAPKLDKSTPKAAVTQIREPKQILNNNSHIAIVNNLENLGDFT

SEQ ID NO: 1887 - protein, 45 aa, Human severe acute respiratory syndrome virus
LMPASKHNLATLLTLFLAIVVGSEALILELVLLVKVHNWNNNVNT

SEQ ID NO: 1888 - protein, 26 aa, Human severe acute respiratory syndrome virus
LLNTRCANLLAQFDVVIAACPKNGLT

SEQ ID NO: 1889 - protein, 15 aa, Human severe acute respiratory syndrome virus
AKILLQGTLLIAAIP

SEQ ID NO: 1890 - protein, 25 aa, Human severe acute respiratory syndrome virus
VAIVFKPKASESSLGFLMVMLVFST

SEQ ID NO: 1891 - protein, 6 aa, Human severe acute respiratory syndrome virus
AAIRSS

SEQ ID NO: 1892 - protein, 47 aa, Human severe acute respiratory syndrome virus
PNSCVTLTPSSDGLSMTLPTTSVVFTSHSMTSFCMVGFSTTSSEVGC

SEQ ID NO: 1893 - protein, 68 aa, Human severe acute respiratory syndrome virus
LSQARLSIPCVSSTARTSNEFEVSTGFVLQRQRKHQVFGLNVVLVVAWLMCQTIGLCSNLAPFLKLAE

SEQ ID NO: 1894 - protein, 28 aa, Human severe acute respiratory syndrome virus
SIATTSPFKSGKNVTDSSREAGFVKPVI

SEQ ID NO: 1895 - protein, 24 aa, Human severe acute respiratory syndrome virus
FKSSANFVLEHVSLKLSKLAFGNG

SEQ ID NO: 1896 - protein, 10 aa, Human severe acute respiratory syndrome virus
VGTRSIGCSV

SEQ ID NO: 1897 - protein, 5 aa, Human severe acute respiratory syndrome virus
ALSFL

SEQ ID NO: 1898 - protein, 10 aa, Human severe acute respiratory syndrome virus
YPSNFGSISV

SEQ ID NO: 1899 - protein, 15 aa, Human severe acute respiratory syndrome virus
VTPSSLYDTGLMVVV

SEQ ID NO: 1900 - protein, 4 aa, Human severe acute respiratory syndrome virus
DVSL

SEQ ID NO: 1901 - protein, 15 aa, Human severe acute respiratory syndrome virus
KTSVTGPLYSDIFVR

SEQ ID NO: 1902 - protein, 5 aa, Human severe acute respiratory syndrome virus
APSIR

SEQ ID NO: 1903 - protein, 7 aa, Human severe acute respiratory syndrome virus
RVSLAVI

SEQ ID NO: 1904 - protein, 54 aa, Human severe acute respiratory syndrome virus
LPVYSFAHKNVPCCNLYSAGGADIITKEDSCCTRYCVASRPHTHGMETPVLRLS

SEQ ID NO: 1905 - protein, 18 aa, Human severe acute respiratory syndrome virus
DRVPIYITASTPVKVVVF

SEQ ID NO: 1906 - protein, 39 aa, Human severe acute respiratory syndrome virus
PQCLHTTLRTRFADSKLACCRRWVIVSLTSPSSPTVLLL

SEQ ID NO: 1907 - protein, 16 aa, Human severe acute respiratory syndrome virus
ASMSAQKLAASPARAL

SEQ ID NO: 1908 - protein, 11 aa, Human severe acute respiratory syndrome virus
SAGALNLTSSC

SEQ ID NO: 1909 - protein, 8 aa, Human severe acute respiratory syndrome virus
SANKTLDK

SEQ ID NO: 1910 - protein, 14 aa, Human severe acute respiratory syndrome virus
QLLSAHLIEVKPPT

SEQ ID NO: 1911 - protein, 24 aa, Human severe acute respiratory syndrome virus
GNFHFFVWFKADMYLPRKLSSRVW

SEQ ID NO: 1912 - protein, 21 aa, Human severe acute respiratory syndrome virus
YSKASLRSVSSLGSTKKVLPS

SEQ ID NO: 1913 - protein, 64 aa, Human severe acute respiratory syndrome virus
GLIFVTSAPSKYVGPNCCPYVIDISTSCVWRLVLSTVVNTFIVLTSRRDKRLFSLSSERTSPSR

SEQ ID NO: 1914 - protein, 29 aa, Human severe acute respiratory syndrome virus
NSTGLSRVWYTILSPRLRNSTPNSVRCPE

SEQ ID NO: 1915 - protein, 4 aa, Human severe acute respiratory syndrome virus
DQSL

SEQ ID NO: 1916 - protein, 58 aa, Human severe acute respiratory syndrome virus
EPAKETVSTKCSSDVFDDEVRYPLYVVTASGDDTDTTAGALRERIQRAASSRLKPCVT

SEQ ID NO: 1917 - protein, 26 aa, Human severe acute respiratory syndrome virus
PIGIVTSGSFREFSFVIIEATGSLLV

SEQ ID NO: 1918 - protein, 6 aa, Human severe acute respiratory syndrome virus
KKNRTP

SEQ ID NO: 1919 - protein, 5 aa, Human severe acute respiratory syndrome virus
STMPS

SEQ ID NO: 1920 - protein, 30 aa, Human severe acute respiratory syndrome virus
ILIPLYLRWMVAIMALTSMHIGINFLVSSA

SEQ ID NO: 1921 - protein, 26 aa, Human severe acute respiratory syndrome virus
ASISLKFQDTVPRISSLALGASEGST

SEQ ID NO: 1922 - protein, 16 aa, Human severe acute respiratory syndrome virus
NADLHFLRAVLASSSV

SEQ ID NO: 1923 - protein, 51 aa, Human severe acute respiratory syndrome virus
PAHPCPGYVVIYSSTGTFFKALESISVVPPAFLEGITTQVISPLVITSPTM

SEQ ID NO: 1924 - protein, 16 aa, Human severe acute respiratory syndrome virus
GASFSRKDISSPLSMF

SEQ ID NO: 1925 - protein, 71 aa, Human severe acute respiratory syndrome virus
SLPLISANKSNLLVRNLVSSSVVVTSSMQALIFGFTSTGFCTTDFSSVLESSVFGGSSCLGASTLGFRLSR

SEQ ID NO: 1926 - protein, 6 aa, Human severe acute respiratory syndrome virus
SMTTCS

SEQ ID NO: 1927 - protein, 8 aa, Human severe acute respiratory syndrome virus
RALSLTAI

SEQ ID NO: 1928 - protein, 13 aa, Human severe acute respiratory syndrome virus
TCVRTVCTHTCKD

SEQ ID NO: 1929 - protein, 69 aa, Human severe acute respiratory syndrome virus
SGLAPNMPADNNGASKMSCELKFSYAALRSWMSSPAFRLGPTTCRHFLARLCPESKQDPPTVRGPFSLM

SEQ ID NO: 1930 - protein, 58 aa, Human severe acute respiratory syndrome virus
SSLSFCMAPLVALLSAPATPPPCFRCMLAAFTITIGLALCASLTMSTHLMATLSVSFK

SEQ ID NO: 1931 - protein, 46 aa, Human severe acute respiratory syndrome virus
LTGSSGVGSGSGSISDCSVVSSSQSSSSSSSTRTVSAEAPNSRGRP

SEQ ID NO: 1932 - protein, 30 aa, Human severe acute respiratory syndrome virus
SSSVPYSCSQVSSISSSSHSASSSSSSSGG

SEQ ID NO: 1933 - protein, 18 aa, Human severe acute respiratory syndrome virus
KEQYIRDEKFSSPASSNK

SEQ ID NO: 1934 - protein, 45 aa, Human severe acute respiratory syndrome virus
NVATLHSSRSIPMLVRRSETGCKVFTTASATTHANSVTSVPDSTV

SEQ ID NO: 1935 - protein, 23 aa, Human severe acute respiratory syndrome virus
TEHFSLSTLSTRSSSSNVILTFL

SEQ ID NO: 1936 - protein, 115 aa, Human severe acute respiratory syndrome virus
TSQTVSSPKVTPLIGAPPFKRKTLFVASKPGDNAQYCSLSLISKSMRPFTQTGVPTIAPFVKLSTGVSSASSSPFLRTTSSEVSTVSCESPSRKVTSFGALRGMSSCSCSLPRIH

SEQ ID NO: 1937 - protein, 4 aa, Human severe acute respiratory syndrome virus
SPLL

SEQ ID NO: 1938 - protein, 19 aa, Human severe acute respiratory syndrome virus
AMKTSPKLSDRNFAPAIVT

SEQ ID NO: 1939 - protein, 28 aa, Human severe acute respiratory syndrome virus
SMHISSALLTTSMKHFTQSLMLSEATCI

SEQ ID NO: 1940 - protein, 51 aa, Human severe acute respiratory syndrome virus
PLTMSKTPVMRNLRISQASLRNSTPALSFASIHSKIGLSFSTVVPKRLDNH

SEQ ID NO: 1941 - protein, 24 aa, Human severe acute respiratory syndrome virus
EVCCTRPPVTYAIIMTLLVSRSEV

SEQ ID NO: 1942 - protein, 76 aa, Human severe acute respiratory syndrome virus
TMASTRRNDCSEIPSSMVTAALCKSGIEWFAASSVRAKIDLITPAACEGKPHSGVKTDLCCPMFQAPFTGFPLVTL

SEQ ID NO: 1943 - protein, 12 aa, Human severe acute respiratory syndrome virus
LPQDSTMVLKDL

SEQ ID NO: 1944 - protein, 27 aa, Human severe acute respiratory syndrome virus
SRLFIVSIKALVEAEKDAKMMATSSFK

SEQ ID NO: 1945 - protein, 45 aa, Human severe acute respiratory syndrome virus
KSPTMLMLTRSRLSISRRSSFKVSTLSPVMPVWPEPISALARGTQ

SEQ ID NO: 1946 - protein, 4 aa, Human severe acute respiratory syndrome virus
ARLL

SEQ ID NO: 1947 - protein, 24 aa, Human severe acute respiratory syndrome virus
ANTQPPKHLVLPPLRSRVSMFEWL

SEQ ID NO: 1948 - protein, 12 aa, Human severe acute respiratory syndrome virus
SATLCSGPISGS

SEQ ID NO: 1949 - protein, 48 aa, Human severe acute respiratory syndrome virus
QAGHGIFTTALVGRYPHVVGPSITKFSVPQCSQVAFRKSHVCHETSSQ

SEQ ID NO: 1950 - protein, 39 aa, Human severe acute respiratory syndrome virus
LHFIKVDKCILLHSCGDATGYTERIRPMKPSVFFFSTRG

SEQ ID NO: 1951 - protein, 35 aa, Human severe acute respiratory syndrome virus
MTLTFELRGNTNFGHSPLKVSNFLALLISKGVWCS

SEQ ID NO: 1952 - protein, 19 aa, Human severe acute respiratory syndrome virus
LLSERSVNQAISCSWSRQQ

SEQ ID NO: 1953 - protein, 7 aa, Human severe acute respiratory syndrome virus
TPLFDSM

SEQ ID NO: 1954 - protein, 35 aa, Human severe acute respiratory syndrome virus
SSCSERVHIDLPARARKSLMQSRGYPSGPQKLLST

SEQ ID NO: 1955 - protein, 27 aa, Human severe acute respiratory syndrome virus
RVTAPPLSSRVSSRSAPLPCLVFQFCS

SEQ ID NO: 1956 - protein, 13 aa, Human severe acute respiratory syndrome virus
SSMGSVPSSSPKS

SEQ ID NO: 1957 - protein, 6 aa, Human severe acute respiratory syndrome virus
DFRSMP

SEQ ID NO: 1958 - protein, 37 aa, Human severe acute respiratory syndrome virus
PPAPLLPFLRRRTLRYAIGVSPTCGTSTPSVIPLRPY

SEQ ID NO: 1959 - protein, 14 aa, Human severe acute respiratory syndrome virus
MPSISATSSTTLWP

SEQ ID NO: 1960 - protein, 12 aa, Human severe acute respiratory syndrome virus
LVLKASERLMNT

SEQ ID NO: 1961 - protein, 45 aa, Human severe acute respiratory syndrome virus
GCSSWGSTPFSSSTRPQVPFLRCSRASDRASSTESPKPRTSTSLT

SEQ ID NO: 1962 - protein, 69 aa, Human severe acute respiratory syndrome virus
RTGKLSWTCVFSLTPRTRLSILPFGHTRTKPRYADDRLQHGRNRKQSAEEGRVTRFLSTTVKFIIVYTA

SEQ ID NO: 1963 - protein, 14 aa, Human severe acute respiratory syndrome virus
ACSRATATQILKFV

SEQ ID NO: 1964 - protein, 16 aa, Human severe acute respiratory syndrome virus
RTDLQEIEVGWLFLGR

SEQ ID NO: 1965 - DNA, 29742 bp, Human severe acute respiratory syndrome virus; identical to SEQ ID NO: 1108
  CDS (3)..(29741)

SEQ ID NO: 1966 - protein, 26 aa, Human severe acute respiratory syndrome virus
FFFFCHSPKKLLKSHGDSTTKINFTH

SEQ ID NO: 1967 - protein, 4 aa, Human severe acute respiratory syndrome virus
GSSI

SEQ ID NO: 1968 - protein, 29 aa, Human severe acute respiratory syndrome virus
AALPSIIHCTLDRTPRGLDENVVALSSPP

SEQ ID NO: 1969 - protein, 21 aa, Human severe acute respiratory syndrome virus
CYTLIKDCYVRLKLTKPTCAV

SEQ ID NO: 1970 - protein, 22 aa, Human severe acute respiratory syndrome virus
LREFILHKSRLCIVNGIAKTFT

SEQ ID NO: 1971 - protein, 8 aa, Human severe acute respiratory syndrome virus
PICLVWSS

SEQ ID NO: 1972 - protein, 55 aa, Human severe acute respiratory syndrome virus
VFMPELNQQKLHSWNFEVVWRNHPCQPQEEESQWAASFVSAAKAELHQSFSFCPF

SEQ ID NO: 1973 - protein, 17 aa, Human severe acute respiratory syndrome virus
ALLVGMFCMRQCACSAV

SEQ ID NO: 1974 - protein, 8 aa, Human severe acute respiratory syndrome virus
IVDLCHPI

SEQ ID NO: 1975 - protein, 12 aa, Human severe acute respiratory syndrome virus
WLHDKSAMFPKV

SEQ ID NO: 1976 - protein, 31 aa, Human severe acute respiratory syndrome virus
LPCQCVTFQRMQRHLEQIVQFAANVCNQFLV

SEQ ID NO: 1977 - protein, 21 aa, Human severe acute respiratory syndrome virus
LGLGPRNFLGFVLDHVSQMLE

SEQ ID NO: 1978 - protein, 14 aa, Human severe acute respiratory syndrome virus
RCTVLWQYVFGEAF

SEQ ID NO: 1979 - protein, 7 aa, Human severe acute respiratory syndrome virus
MPQQQIS

SEQ ID NO: 1980 - protein, 34 aa, Human severe acute respiratory syndrome virus
QFGLVVVGLYQKLCSQAGSICLAAIARGQFHHLR

SEQ ID NO: 1981 - protein, 59 aa, Human severe acute respiratory syndrome virus
PFEQENFPYCCQELNFLNYRDYVMRSEKRLDCRLCFPLRRSLLAMLFLEEVVARWQHCY

SEQ ID NO: 1982 - protein, 25 aa, Human severe acute respiratory syndrome virus
DCGCQCGLWVYSRLPQLQPIRCLLC

SEQ ID NO: 1983 - protein, 20 aa, Human severe acute respiratory syndrome virus
RRREVKLLGQFLGNRSTIWG

SEQ ID NO: 1984 - protein, 13 aa, Human severe acute respiratory syndrome virus
ALSFCRHHHELVG

SEQ ID NO: 1985 - protein, 15 aa, Human severe acute respiratory syndrome virus
LFGSSQFGHLDHYWC

SEQ ID NO: 1986 - protein, 9 aa, Human severe acute respiratory syndrome virus
LERPGLEGI

SEQ ID NO: 1987 - protein, 7 aa, Human severe acute respiratory syndrome virus
VPPCHAE

SEQ ID NO: 1988 - protein, 37 aa, Human severe acute respiratory syndrome virus
TKTQYYWVNLGVGAVLALPHCVLHSGYCQLNLWVHQM

SEQ ID NO: 1989 - protein, 16 aa, Human severe acute respiratory syndrome virus
CGGHYVGLIGVHYQTF

SEQ ID NO: 1990 - protein, 17 aa, Human severe acute respiratory syndrome virus
FVRLFKTTSTSLNAAVW

SEQ ID NO: 1991 - protein, 14 aa, Human severe acute respiratory syndrome virus
RYQHLAISAPPAGS

SEQ ID NO: 1992 - protein, 10 aa, Human severe acute respiratory syndrome virus
QLIVTLGVHV

SEQ ID NO: 1993 - protein, 6 aa, Human severe acute respiratory syndrome virus
TIVCHL

SEQ ID NO: 1994 - protein, 14 aa, Human severe acute respiratory syndrome virus
KGKTFPRAQSQAVL

SEQ ID NO: 1995 - protein, 31 aa, Human severe acute respiratory syndrome virus
VLPLVLYLTRIFKHMRFIRCTALYYSAYATA

SEQ ID NO: 1996 - protein, 21 aa, Human severe acute respiratory syndrome virus
RNTSQNNEKFHVRLDFGTRFF

SEQ ID NO: 1997 - protein, 5 aa, Human severe acute respiratory syndrome virus
ILDFE

SEQ ID NO: 1998 - protein, 8 aa, Human severe acute respiratory syndrome virus
KPKYNKHY

SEQ ID NO: 1999 - protein, 7 aa, Human severe acute respiratory syndrome virus
KAQIEVN

SEQ ID NO: 2000 - protein, 29 aa, Human severe acute respiratory syndrome virus
SELIHSVFLLMVKQSIKNTRAATMRKSGE

SEQ ID NO: 2001 - protein, 17 aa, Human severe acute respiratory syndrome virus
TSSCLMKSFGETDLARS

SEQ ID NO: 2002 - protein, 27 aa, Human severe acute respiratory syndrome virus
VCRVPSAQAKAKCVLVQVSANLLSARG

SEQ ID NO: 2003 - protein, 25 aa, Human severe acute respiratory syndrome virus
NGELPSYVPDGQGSFSSTVVPLTHS

SEQ ID NO: 2004 - protein, 24 aa, Human severe acute respiratory syndrome virus
YSSQDVNTINVRKRIIFMFVLWII

SEQ ID NO: 2005 - protein, 7 aa, Human severe acute respiratory syndrome virus
LHRFFII

SEQ ID NO: 2006 - protein, 7 aa, Human severe acute respiratory syndrome virus
LRIILLS

SEQ ID NO: 2007 - protein, 4 aa, Human severe acute respiratory syndrome virus
LSHY

SEQ ID NO: 2008 - protein, 89 aa, Human severe acute respiratory syndrome virus
TYYNVKIPNSNPESPHNDNQYLCYCNLEVNKMKHLLSLTVLAKQYCRCYRRGLYLIYSFQYGSGCMQQNLNQCLHAATLLICNKKAFVM

SEQ ID NO: 2009 - protein, 6 aa, Human severe acute respiratory syndrome virus
SLLAGP

SEQ ID NO: 2010 - protein, 16 aa, Human severe acute respiratory syndrome virus
CHSALGSVRPFASDHE

SEQ ID NO: 2011 - protein, 4 aa, Human severe acute respiratory syndrome virus
SQHQ

SEQ ID NO: 2012 - protein, 5 aa, Human severe acute respiratory syndrome virus
QVHFP

SEQ ID NO: 2013 - protein, 12 aa, Human severe acute respiratory syndrome virus
AVWSQLSPGEAH

SEQ ID NO: 2014 - protein, 7 aa, Human severe acute respiratory syndrome virus
EECLFLG

SEQ ID NO: 2015 - protein, 11 aa, Human severe acute respiratory syndrome virus
MTTLSGYEQTA

SEQ ID NO: 2016 - protein, 6 aa, Human severe acute respiratory syndrome virus
RKQRSS

SEQ ID NO: 2017 - protein, 19 aa, Human severe acute respiratory syndrome virus
ATSSLQYKPLQSQSRQSPN

SEQ ID NO: 2018 - protein, 32 aa, Human severe acute respiratory syndrome virus
FCRQQQAQNKQVLLATRARGKQALLCTKTCSD

SEQ ID NO: 2019 - protein, 7 aa, Human severe acute respiratory syndrome virus
NRQIVVT

SEQ ID NO: 2020 - protein, 18 aa, Human severe acute respiratory syndrome virus
SRLGIGNLLLGSIVPGVV

SEQ ID NO: 2021 - protein, 4 aa, Human severe acute respiratory syndrome virus
APQR

SEQ ID NO: 2022 - protein, 5 aa, Human severe acute respiratory syndrome virus
YRCLP

SEQ ID NO: 2023 - protein, 8 aa, Human severe acute respiratory syndrome virus
AMLKFQTE

SEQ ID NO: 2024 - protein, 29 aa, Human severe acute respiratory syndrome virus
LVRLDQKIRNSFRRVQIFNTRVDVNRWFY

SEQ ID NO: 2025 - protein, 19 aa, Human severe acute respiratory syndrome virus
THVNNIAAVRTQSKRSKDG

SEQ ID NO: 2026 - protein, 15 aa, Human severe acute respiratory syndrome virus
QEYHESKKKKYAINY

SEQ ID NO: 2027 - protein, 8 aa, Human severe acute respiratory syndrome virus
RTCFFRNE

SEQ ID NO: 2028 - protein, 33 aa, Human severe acute respiratory syndrome virus
VHKFVLTFLCLQRHASSRRRLIINWIHCWISNS

SEQ ID NO: 2029 - protein, 56 aa, Human severe acute respiratory syndrome virus
RAVDCVYLHIRWVFNKLVKDEECSIFNTSVCSNLCRLKLVVNFGEIAMYNDIVFNT

SEQ ID NO: 2030 - protein, 18 aa, Human severe acute respiratory syndrome virus
VPILRITTNLVVFFEFWC

SEQ ID NO: 2031 - protein, 36 aa, Human severe acute respiratory syndrome virus
NAVTFSNDNCICDTVIWYTVVIVMCVPANKVVGIIK

SEQ ID NO: 2032 - protein, 23 aa, Human severe acute respiratory syndrome virus
WVLGFALPTKPTSHNNSTCVDAL

SEQ ID NO: 2033 - protein, 22 aa, Human severe acute respiratory syndrome virus
KIYQGIEVQKLRLLTCSDKQKM

SEQ ID NO: 2034 - protein, 5 aa, Human severe acute respiratory syndrome virus
IDGNK

SEQ ID NO: 2035 - protein, 11 aa, Human severe acute respiratory syndrome virus
IANELEALIKG

SEQ ID NO: 2036 - protein, 30 aa, Human severe acute respiratory syndrome virus
LPSFIERNYFGSALKNSKKCNANNKPSERE

SEQ ID NO: 2037 - protein, 24 aa, Human severe acute respiratory syndrome virus
RYRCCSMNSTCRRSIVNFYWLCSN

SEQ ID NO: 2038 - protein, 16 aa, Human severe acute respiratory syndrome virus
SKSKKSHKQIHKFVYV

SEQ ID NO: 2039 - protein, 70 aa, Human severe acute respiratory syndrome virus
CNLTPLRTGSESSSSNLQQEPQEHAPLRQLQQLVMQQSKIVTMTMAISPAMKPSQTYQGHLIYCSYFPNS

SEQ ID NO: 2040 - protein, 20 aa, Human severe acute respiratory syndrome virus
RSMSDSFKFLATSLRRSISF

SEQ ID NO: 2041 - protein, 20 aa, Human severe acute respiratory syndrome virus
MLTTEALMPEMSPRSTSGDV

SEQ ID NO: 2042 - protein, 20 aa, Human severe acute respiratory syndrome virus
FLKYLSSSSLNESSSGCRGS

SEQ ID NO: 2043 - protein, 54 aa, Human severe acute respiratory syndrome virus
TVLLMMPITTSQFPETNVLSVVIICGEKKFLCVINQEVPLNTKTPSRGKYALPS

SEQ ID NO: 2044 - protein, 35 aa, Human severe acute respiratory syndrome virus
QIAGAVVKFLSWDGTYVTCRKTTPCGAACGKDIRW

SEQ ID NO: 2045 - protein, 39 aa, Human severe acute respiratory syndrome virus
PFPQKSTLFDCPRTHSDILVAARLAEALISAALISCCVT

SEQ ID NO: 2046 - protein, 44 aa, Human severe acute respiratory syndrome virus
SLPVINLSICTSASTLSSRERISFSTLEIAPKLELSCLTSVFNA

SEQ ID NO: 2047 - protein, 21 aa, Human severe acute respiratory syndrome virus
AFWLTTSCSLPNAVDVVVSDS

SEQ ID NO: 2048 - protein, 15 aa, Human severe acute respiratory syndrome virus
LIALLNWLAICFWFS

SEQ ID NO: 2049 - protein, 21 aa, Human severe acute respiratory syndrome virus
RTFWVTPMPLNLYAICIAKGI

SEQ ID NO: 2050 - protein, 21 aa, Human severe acute respiratory syndrome virus
RAAPAPNVHPAVAVPLTRAAV

SEQ ID NO: 2051 - protein, 88 aa, Human severe acute respiratory syndrome virus
AAIISSVSRGGNTVSPLNFCAQMRSLALISPRHSPYCFMKPASASVTLLKSKSSIKDLLVGFRGSGNICEKLKPPKYFKVGVLYICLT

SEQ ID NO: 2052 - protein, 76 aa, Human severe acute respiratory syndrome virus
ANTSRVLRSCSAAIPESARFSCVQKLPYWRSKLAHSVESPQMYILQSTEVLAIETGITSVVMLIEKLVGIAMVLLE

SEQ ID NO: 2053 - protein, 11 aa, Human severe acute respiratory syndrome virus
AIELSAPKDIV

SEQ ID NO: 2054 - protein, 16 aa, Human severe acute respiratory syndrome virus
ATIDFWLVLRNKETVW

SEQ ID NO: 2055 - protein, 13 aa, Human severe acute respiratory syndrome virus
LAQMPAPIGMSHS

SEQ ID NO: 2056 - protein, 13 aa, Human severe acute respiratory syndrome virus
EVSTCSAPIRQPA

SEQ ID NO: 2057 - protein, 17 aa, Human severe acute respiratory syndrome virus
VWNTLFPVEYMRQAGVS

SEQ ID NO: 2058 - protein, 11 aa, Human severe acute respiratory syndrome virus
IAVETSVQLTS

SEQ ID NO: 2059 - protein, 49 aa, Human severe acute respiratory syndrome virus
YRTATSDEAFVPGVITLTPPKEQGEMSNISDVLGSRTESVKSETSRPNC

SEQ ID NO: 2060 - protein, 51 aa, Human severe acute respiratory syndrome virus
NLFEEGVNTPVPVSPLKLKLTHWFLIRSVDNFGPQTVAGAFKSSKESTTTL

SEQ ID NO: 2061 - protein, 6 aa, Human severe acute respiratory syndrome virus
PMPVVV

SEQ ID NO: 2062 - protein, 5 aa, Human severe acute respiratory syndrome virus
SFNGQ

SEQ ID NO: 2063 - protein, 36 aa, Human severe acute respiratory syndrome virus
QLRAGGVQGLPSGEKGTLDMSLSKGLSLPCLRYLYL

SEQ ID NO: 2064 - protein, 25 aa, Human severe acute respiratory syndrome virus
LPVEVASMFLVFQARTQPMKSSGNL

SEQ ID NO: 2065 - protein, 24 aa, Human severe acute respiratory syndrome virus
SAITPVCPGAICLTSSPLTTKESA

SEQ ID NO: 2066 - protein, 15 aa, Human severe acute respiratory syndrome virus
TLEKQRSFNLVAETP

SEQ ID NO: 2067 - protein, 10 aa, Human severe acute respiratory syndrome virus
HLKVEKNVEL

SEQ ID NO: 2068 - protein, 13 aa, Human severe acute respiratory syndrome virus
SATQLEIFFLSHA

SEQ ID NO: 2069 - protein, 37 aa, Human severe acute respiratory syndrome virus
TEGNLVALKTSPKGHKFVILGNLTTSPEGTTLKLEVW

SEQ ID NO: 2070 - protein, 19 aa, Human severe acute respiratory syndrome virus
IPLSISKLLTEHLSSASGF

SEQ ID NO: 2071 - protein, 23 aa, Human severe acute respiratory syndrome virus
EQSTASVIVPFSSYLSINVVGFK

SEQ ID NO: 2072 - protein, 9 aa, Human severe acute respiratory syndrome virus
AAADVPQMS

SEQ ID NO: 2073 - protein, 40 aa, Human severe acute respiratory syndrome virus
AGEKAVRMALKFVMLIPRGNLKIGFKVLKPEGRSRTTSIG

SEQ ID NO: 2074 - protein, 106 aa, Human severe acute respiratory syndrome virus
RNPSLFLNTNSRKCLKLPDFSETSSEKASDMYSKVQLNALSNIIVCVCVPMGLETAKKGLSHNSKLHARITTLVELLIIITDCDLLFMVEPKTQPRTTFDFSVAAK

SEQ ID NO: 2075 - protein, 13 aa, Human severe acute respiratory syndrome virus
IPSLKGMTGLPNV

SEQ ID NO: 2076 - protein, 6 aa, Human severe acute respiratory syndrome virus
NPVTLE

SEQ ID NO: 2077 - protein, 6 aa, Human severe acute respiratory syndrome virus
NGRNKS

SEQ ID NO: 2078 - protein, 10 aa, Human severe acute respiratory syndrome virus
RVSDLKISSG

SEQ ID NO: 2079 - protein, 8 aa, Human severe acute respiratory syndrome virus
TPLIDEVC

SEQ ID NO: 2080 - protein, 27 aa, Human severe acute respiratory syndrome virus
TSSKVVHRSRSLPLVRVRNNKKINMFV

SEQ ID NO: 2081 - protein, 26 aa, Human severe acute respiratory syndrome virus
LLTRISLETTTLLFSLMISLPFSRRE

SEQ ID NO: 2082 - protein, 5 aa, Human severe acute respiratory syndrome virus
IISLI

SEQ ID NO: 2083 - protein, 23 aa, Human severe acute respiratory syndrome virus
FSLRDITAVPLNLRGNLLMSKSE

SEQ ID NO: 2084 - protein, 13 aa, Human severe acute respiratory syndrome virus
EDNWIGFVFLQKM

SEQ ID NO: 2085 - protein, 5 aa, Human severe acute respiratory syndrome virus
LACMV

SEQ ID NO: 2086 - protein, 10 aa, Human severe acute respiratory syndrome virus
PSICSFGLPR

SEQ ID NO: 2087 - protein, 29 aa, Human severe acute respiratory syndrome virus
LAPIKNASDDDAFTFVTKAVHHEKWPISL

SEQ ID NO: 2088 - protein, 28 aa, Human severe acute respiratory syndrome virus
RSAFQECSVIFTAIEPPRASFCFINPHR

SEQ ID NO: 2089 - protein, 82 aa, Human severe acute respiratory syndrome virus
VKNPSLESFSFVTCLVLGSYISLIIRSHLLAVCTVAQSPIKVESASETKSLRSESTSSVPVGNHCLSTAVPGATPLSEPAPK

SEQ ID NO: 2090 - protein, 5 aa, Human severe acute respiratory syndrome virus
ITLML

SEQ ID NO: 2091 - protein, 10 aa, Human severe acute respiratory syndrome virus
GTAKVSVFKY

SEQ ID NO: 2092 - protein, 18 aa, Human severe acute respiratory syndrome virus
VYFATFIIIPFGITAFSP

SEQ ID NO: 2093 - protein, 24 aa, Human severe acute respiratory syndrome virus
RSHFSRSILCILYKLGIATPGCHA

SEQ ID NO: 2094 - protein, 6 aa, Human severe acute respiratory syndrome virus
LACSFG

SEQ ID NO: 2095 - protein, 17 aa, Human severe acute respiratory syndrome virus
KVSTCPSLHQSMNEISA

SEQ ID NO: 2096 - protein, 45 aa, Human severe acute respiratory syndrome virus
SIVTLTTFEITDKSCDFIISTKSSSKRSITEHTHFDEPVCASVMK

SEQ ID NO: 2097 - protein, 28 aa, Human severe acute respiratory syndrome virus
FFTVLSIGIKSSNLSGESCERLAKPIIK

SEQ ID NO: 2098 - protein, 6 aa, Human severe acute respiratory syndrome virus
RPPSCP

SEQ ID NO: 2099 - protein, 4 aa, Human severe acute respiratory syndrome virus
LKSP

SEQ ID NO: 2100 - protein, 6 aa, Human severe acute respiratory syndrome virus
TMCSKA

SEQ ID NO: 2101 - protein, 33 aa, Human severe acute respiratory syndrome virus
PSSLYRCMNSSIASSRKSVSICDLGLKSSKSLL

SEQ ID NO: 2102 - protein, 5 aa, Human severe acute respiratory syndrome virus
VSGNC

SEQ ID NO: 2103 - protein, 8 aa, Human severe acute respiratory syndrome virus
IMPSTFLK

SEQ ID NO: 2104 - protein, 89 aa, Human severe acute respiratory syndrome virus
LNCVFTDSPINVTPLTLACAGPFEGVRPLTEPSVIKTPLRAFLKRSTCPSTLPSNKTVSEEQALSVGFLAMSVIVQTPIVDTCAGASLL

SEQ ID NO: 2105 - protein, 55 aa, Human severe acute respiratory syndrome virus
SQITVLAAISTPKLLSILISGTGLMLRLAQSSNATLTGSVVLFSKISTSIPSTFV

SEQ ID NO: 2106 - protein, 24 aa, Human severe acute respiratory syndrome virus
TALLMMETGASPACPSKCPLLTTL

SEQ ID NO: 2107 - protein, 16 aa, Human severe acute respiratory syndrome virus
ATFSKLCNLVNVFHRL

SEQ ID NO: 2108 - protein, 5 aa, Human severe acute respiratory syndrome virus
VSNCL

SEQ ID NO: 2109 - protein, 45 aa, Human severe acute respiratory syndrome virus
IHRLNPAEIIILYASKYCRYSFAWCLQTAPPKLHRVIHVADLSGT

SEQ ID NO: 2110 - protein, 9 aa, Human severe acute respiratory syndrome virus
SISDTTCLP

SEQ ID NO: 2111 - protein, 7 aa, Human severe acute respiratory syndrome virus
DSQGLSE

SEQ ID NO: 2112 - protein, 53 aa, Human severe acute respiratory syndrome virus
KKGNCFKLVNALLSKAGVWNACLFTYKLPPSQPGKFKFDKTLVSNLHTIALAG

SEQ ID NO: 2113 - protein, 17 aa, Human severe acute respiratory syndrome virus
RSTLQFQNKQTPSVNLS

SEQ ID NO: 2114 - protein, 6 aa, Human severe acute respiratory syndrome virus
KSSSIL

SEQ ID NO: 2115 - protein, 6 aa, Human severe acute respiratory syndrome virus
ALSLHG

SEQ ID NO: 2116 - protein, 7 aa, Human severe acute respiratory syndrome virus
NFHSTSA

SEQ ID NO: 2117 - protein, 12 aa, Human severe acute respiratory syndrome virus
GTHLIAFGFPMS

SEQ ID NO: 2118 - protein, 75 aa, Human severe acute respiratory syndrome virus
RTGNLSASNADFTTMCCTFLQAELTLSSSPIIGYSTDQSTRLTKHSWTAKHLVMIASQLATCAFPCTWQCWSWLL

SEQ ID NO: 2119 - protein, 8 aa, Human severe acute respiratory syndrome virus
RLPVKPHC

SEQ ID NO: 2120 - protein, 7 aa, Human severe acute respiratory syndrome virus
TSIINGL

SEQ ID NO: 2121 - protein, 5 aa, Human severe acute respiratory syndrome virus
SKPTE

SEQ ID NO: 2122 - protein, 4 aa, Human severe acute respiratory syndrome virus
FQQA

SEQ ID NO: 2123 - protein, 99 aa, Human severe acute respiratory syndrome virus
VSDEVEKQVARLSHRQHVLSGPILTKYFIDVSSKPCAQRTNTTLSDNPFSVSLSICTILIRTTFQGKPLYMSGIRCLNWSPGGGFALTLVNSVLFSVST

SEQ ID NO: 2124 - protein, 28 aa, Human severe acute respiratory syndrome virus
PVGTATKLTPVENPSWRGRLVPTASLVA

SEQ ID NO: 2125 - protein, 12 aa, Human severe acute respiratory syndrome virus
QPSTSKPIHART

SEQ ID NO: 2126 - protein, 12 aa, Human severe acute respiratory syndrome virus
RIASSRVINILG

SEQ ID NO: 2127 - protein, 4 aa, Human severe acute respiratory syndrome virus
PLTW

SEQ ID NO: 2128 - protein, 12 aa, Human severe acute respiratory syndrome virus
FILKPIIEMSLR

SEQ ID NO: 2129 - protein, 31 aa, Human severe acute respiratory syndrome virus
VMSFGMPGMSTHNPSVLNFISTLRCVGACVG

SEQ ID NO: 2130 - protein, 37 aa, Human severe acute respiratory syndrome virus
RPVMILLQSLKSPVTFSACNVATLRRGISRLVNCSLS

SEQ ID NO: 2131 - protein, 38 aa, Human severe acute respiratory syndrome virus
RSLSDIMHKMPIFALVIATLKRLTLQECAVSVVCVNMT

SEQ ID NO: 2132 - protein, 27 aa, Human severe acute respiratory syndrome virus
SYSEPCDESTVCVGNPKIFEATAFCEL

SEQ ID NO: 2133 - protein, 22 aa, Human severe acute respiratory syndrome virus
GEIKTAFLQAGLRVRNSLTTPI

SEQ ID NO: 2134 - protein, 15 aa, Human severe acute respiratory syndrome virus
GLLIADETSCVITPL

SEQ ID NO: 2135 - protein, 5 aa, Human severe acute respiratory syndrome virus
NILKH

SEQ ID NO: 2136 - protein, 12 aa, Human severe acute respiratory syndrome virus
ADLSLCAFSLLS

SEQ ID NO: 2137 - protein, 52 aa, Human severe acute respiratory syndrome virus
TKALTVSTISAGQRRQVPRNMSGPIVFISLHTELKYSGSSVPLVSNVRGAGN

SEQ ID NO: 2138 - protein, 5 aa, Human severe acute respiratory syndrome virus
AGSPI

SEQ ID NO: 2139 - protein, 13 aa, Human severe acute respiratory syndrome virus
CFARSLALTTLKS

SEQ ID NO: 2140 - protein, 70 aa, Human severe acute respiratory syndrome virus
LVAIEISSKTTMSAVVSGNAFTVQKTYCSSVEFTLNLSKHSTRARAGMILLHLSMGKYFNAFSHRASTAA

SEQ ID NO: 2141 - protein, 11 aa, Human severe acute respiratory syndrome virus
EHAVYTMRADG

SEQ ID NO: 2142 - protein, 7 aa, Human severe acute respiratory syndrome virus
RASPMAK

SEQ ID NO: 2143 - protein, 19 aa, Human severe acute respiratory syndrome virus
LLPVPGGPWSVEYFCMPTF

SEQ ID NO: 2144 - protein, 22 aa, Human severe acute respiratory syndrome virus
FATLLENSSEMLSVGYKPVILT

SEQ ID NO: 2145 - protein, 15 aa, Human severe acute respiratory syndrome virus
CSCGTRVGALSGITV

SEQ ID NO: 2146 - protein, 5 aa, Human severe acute respiratory syndrome virus
DVNTK

SEQ ID NO: 2147 - protein, 18 aa, Human severe acute respiratory syndrome virus
SPTFNLYVVVPLYTTASP

SEQ ID NO: 2148 - protein, 19 aa, Human severe acute respiratory syndrome virus
SPFSKVYSPICTLLFLVTR

SEQ ID NO: 2149 - protein, 4 aa, Human severe acute respiratory syndrome virus
PVKT

SEQ ID NO: 2150 - protein, 59 aa, Human severe acute respiratory syndrome virus
FLFNGGLGFPTSHERCNSLSESTSRTVAIPYDSLNVSSVALSVSAAKSLSLSVQVLASM

SEQ ID NO: 2151 - protein, 31 aa, Human severe acute respiratory syndrome virus
SPALVQSHVAIALKSVTLSLPTHVFLYKPKT

SEQ ID NO: 2152 - protein, 16 aa, Human severe acute respiratory syndrome virus
PLAHNGKLMGGLCDLQ

SEQ ID NO: 2153 - protein, 21 aa, Human severe acute respiratory syndrome virus
LIPPRYSCVTSVTSQPGALQT

SEQ ID NO: 2154 - protein, 16 aa, Human severe acute respiratory syndrome virus
GLTDNTNLCDVEMTWS

SEQ ID NO: 2155 - protein, 41 aa, Human severe acute respiratory syndrome virus
QHLQHRNGLLIQAPQRSEVCELHNTQAPTACKTVCGVYIAS

SEQ ID NO: 2156 - protein, 38 aa, Human severe acute respiratory syndrome virus
NSGSQYREVLSLVSITEYMSNMWPVSSSCNFLMYCKYK

SEQ ID NO: 2157 - protein, 6 aa, Human severe acute respiratory syndrome virus
KTSAYS

SEQ ID NO: 2158 - protein, 7 aa, Human severe acute respiratory syndrome virus
LGCFVSG

SEQ ID NO: 2159 - protein, 35 aa, Human severe acute respiratory syndrome virus
ASIASDTNLSIISVPSVLTISSTKQPAPNILDGSG

SEQ ID NO: 2160 - protein, 4 aa, Human severe acute respiratory syndrome virus
GRYT

SEQ ID NO: 2161 - protein, 15 aa, Human severe acute respiratory syndrome virus
SSPCLTSIVCCEQNS

SEQ ID NO: 2162 - protein, 20 aa, Human severe acute respiratory syndrome virus
GPLVRSVSVQHFASDMNTLF

SEQ ID NO: 2163 - protein, 13 aa, Human severe acute respiratory syndrome virus
RTALKFLMLATKP

SEQ ID NO: 2164 - protein, 17 aa, Human severe acute respiratory syndrome virus
HTTASSERIIMEKCLRR

SEQ ID NO: 2165 - protein, 6 aa, Human severe acute respiratory syndrome virus
NSSTNS

SEQ ID NO: 2166 - protein, 6 aa, Human severe acute respiratory syndrome virus
STSLFL

SEQ ID NO: 2167 - protein, 29 aa, Human severe acute respiratory syndrome virus
SLCCRLRTYLSAILLPSVERSAFTLAVTA

SEQ ID NO: 2168 - protein, 8 aa, Human severe acute respiratory syndrome virus
QMLKTLLA

SEQ ID NO: 2169 - protein, 35 aa, Human severe acute respiratory syndrome virus
AVVASPDDVPPGLTYSEPPHMTISLNTCAHSLANL

SEQ ID NO: 2170 - protein, 33 aa, Human severe acute respiratory syndrome virus
KRCDKLQQVLCLRARTREAIILSMLGMALSHFG

SEQ ID NO: 2171 - protein, 12 aa, Human severe acute respiratory syndrome virus
SQPIRCGVSTSL

SEQ ID NO: 2172 - protein, 10 aa, Human severe acute respiratory syndrome virus
TVFNILCQPP

SEQ ID NO: 2173 - protein, 21 aa, Human severe acute respiratory syndrome virus
NLLVPITTVAPLVAAIDFNNF

SEQ ID NO: 2174 - protein, 30 aa, Human severe acute respiratory syndrome virus
NCLFVIVLQIETPATVRALFFALMAYLRFI

SEQ ID NO: 2175 - protein, 16 aa, Human severe acute respiratory syndrome virus
VIVGMTLRLVYAKSAS

SEQ ID NO: 2176 - protein, 4 aa, Human severe acute respiratory syndrome virus
LIES

SEQ ID NO: 2177 - protein, 31 aa, Human severe acute respiratory syndrome virus
SLALPHLLNGKPADLSRLLTITWLALIQPPS

SEQ ID NO: 2178 - protein, 24 aa, Human severe acute respiratory syndrome virus
QSKYLSTTSTTNRSCLISHIVGRL

SEQ ID NO: 2179 - protein, 8 aa, Human severe acute respiratory syndrome virus
SLIAALPS

SEQ ID NO: 2180 - protein, 23 aa, Human severe acute respiratory syndrome virus
AKKKCFSSTELPSLKKPLDTAKS

SEQ ID NO: 2181 - protein, 11 aa, Human severe acute respiratory syndrome virus
KSLLKLPGLTV

SEQ ID NO: 2182 - protein, 50 aa, Human severe acute respiratory syndrome virus
KATLFVSAATEKHVVRLSSNKLPEAACIAGSAAYTKSSLKLRRELCKFTS

SEQ ID NO: 2183 - protein, 47 aa, Human severe acute respiratory syndrome virus
LCTTPNSRKWYPVETTKGTPSTNIFLTSGPKLVGGNTVENNTLKFAQ

SEQ ID NO: 2184 - protein, 22 aa, Human severe acute respiratory syndrome virus
RIHLSSKQLIQLGWYVWSQYLK

SEQ ID NO: 2185 - protein, 47 aa, Human severe acute respiratory syndrome virus
RSKRQSLSSVKSYFSKSHLISGFARSASIWDSAANALVKVRMGISNE

SEQ ID NO: 2186 - protein, 27 aa, Human severe acute respiratory syndrome virus
YESTIGTPQPGATCTKSPKSYQFPLRS

SEQ ID NO: 2187 - protein, 53 aa, Human severe acute respiratory syndrome virus
LSNVSTPTMPASRIASQNCTVFNNDWRTRSPKLAYTRKMSGFSTKSYQSFLLK

SEQ ID NO: 2188 - protein, 22 aa, Human severe acute respiratory syndrome virus
SSSQQLYVTSISFNVSQLPSSK

SEQ ID NO: 2189 - protein, 11 aa, Human severe acute respiratory syndrome virus
TKSAIVYLVRR

SEQ ID NO: 2190 - protein, 29 aa, Human severe acute respiratory syndrome virus
RDICGTMSPSTLNLKKSWTATAGQSLTKL

SEQ ID NO: 2191 - protein, 6 aa, Human severe acute respiratory syndrome virus
IVSSCW

SEQ ID NO: 2192 - protein, 10 aa, Human severe acute respiratory syndrome virus
LDIVCLLTTK

SEQ ID NO: 2193 - protein, 30 aa, Human severe acute respiratory syndrome virus
ESNKLPSSSFSWKRQQLVFRNFAKPALFSL

SEQ ID NO: 2194 - protein, 5 aa, Human severe acute respiratory syndrome virus
ISKAL

SEQ ID NO: 2195 - protein, 57 aa, Human severe acute respiratory syndrome virus
TTSVLVPVPHGVRRAALTPQTRLKTLMHPQTASRVRGVGHNYSHNLSTFRRRYRLCF

SEQ ID NO: 2196 - protein, 5 aa, Human severe acute respiratory syndrome virus
NPLGH

SEQ ID NO: 2197 - protein, 13 aa, Human severe acute respiratory syndrome virus
VFGRTYLSSHRIL

SEQ ID NO: 2198 - protein, 24 aa, Human severe acute respiratory syndrome virus
DLDGQCGIYNTDNMKHHQRTLGPC

SEQ ID NO: 2199 - protein, 5 aa, Human severe acute respiratory syndrome virus
LLVLQ

SEQ ID NO: 2200 - protein, 16 aa, Human severe acute respiratory syndrome virus
LPVLYQCVYTTSSHSW

SEQ ID NO: 2201 - protein, 13 aa, Human severe acute respiratory syndrome virus
LVVLHLLGNPYML

SEQ ID NO: 2202 - protein, 19 aa, Human severe acute respiratory syndrome virus
QGLLQKHRRKAQLNWQVLL

SEQ ID NO: 2203 - protein, 8 aa, Human severe acute respiratory syndrome virus
HFQPEDVL

SEQ ID NO: 2204 - protein, 16 aa, Human severe acute respiratory syndrome virus
QLNCPAPYLYLGCLSL

SEQ ID NO: 2205 - protein, 6 aa, Human severe acute respiratory syndrome virus
STSISL

SEQ ID NO: 2206 - protein, 6 aa, Human severe acute respiratory syndrome virus
ALLVCL

SEQ ID NO: 2207 - protein, 18 aa, Human severe acute respiratory syndrome virus
QTYKVVPVLCKLYLYHHS

SEQ ID NO: 2208 - protein, 53 aa, Human severe acute respiratory syndrome virus
DLGGLIVMPAQTYLPSNCYSRQVHCHQYKLFVWYQPHRTSVVVLLDSVHYSVV

SEQ ID NO: 2209 - protein, 8 aa, Human severe acute respiratory syndrome virus
QLSWLLEL

SEQ ID NO: 2210 - protein, 11 aa, Human severe acute respiratory syndrome virus
EAKPNLVNCPC

SEQ ID NO: 2211 - protein, 21 aa, Human severe acute respiratory syndrome virus
VEQSCYPHQQLAGFPRVQMHM

SEQ ID NO: 2212 - protein, 18 aa, Human severe acute respiratory syndrome virus
RCYHHKCSCRYHNQGQQP

SEQ ID NO: 2213 - protein, 4 aa, Human severe acute respiratory syndrome virus
VWLL

SEQ ID NO: 2214 - protein, 9 aa, Human severe acute respiratory syndrome virus
VEHNHHAHC

SEQ ID NO: 2215 - protein, 7 aa, Human severe acute respiratory syndrome virus
VHHYQAS

SEQ ID NO: 2216 - protein, 5 aa, Human severe acute respiratory syndrome virus
RALFA

SEQ ID NO: 2217 - protein, 17 aa, Human severe acute respiratory syndrome virus
LLLPSCPQILPVCTFGS

SEQ ID NO: 2218 - protein, 20 aa, Human severe acute respiratory syndrome virus
PDLPSFPTCVAWQHHGQTQI

SEQ ID NO: 2219 - protein, 9 aa, Human severe acute respiratory syndrome virus
PHSKISLTF

SEQ ID NO: 2220 - protein, 7 aa, Human severe acute respiratory syndrome virus
ERLQNHH

SEQ ID NO: 2221 - protein, 20 aa, Human severe acute respiratory syndrome virus
LQPAHRPPGQWHKRHMMVKN

SEQ ID NO: 2222 - protein, 4 aa, Human severe acute respiratory syndrome virus
ILKQ

SEQ ID NO: 2223 - protein, 11 aa, Human severe acute respiratory syndrome virus
HGYRAFPRTTY

SEQ ID NO: 2224 - protein, 41 aa, Human severe acute respiratory syndrome virus
CLQHPAWIAKQTKEKPSSRKLQLCLLQEEYHCGVVHIVPTI

SEQ ID NO: 2225 - protein, 5 aa, Human severe acute respiratory syndrome virus
KMTLL

SEQ ID NO: 2226 - protein, 18 aa, Human severe acute respiratory syndrome virus
VVEEPRAVPQMCTLRQTF

SEQ ID NO: 2227 - protein, 10 aa, Human severe acute respiratory syndrome virus
YMVYLQYPTT

SEQ ID NO: 2228 - protein, 6 aa, Human severe acute respiratory syndrome virus
KHQYYS

SEQ ID NO: 2229 - protein, 10 aa, Human severe acute respiratory syndrome virus
EAKAPGSSYT

SEQ ID NO: 2230 - protein, 9 aa, Human severe acute respiratory syndrome virus
RPSSHKHQE

SEQ ID NO: 2231 - protein, 20 aa, Human severe acute respiratory syndrome virus
VNRKGQSSSSNNSLRNNKQA

SEQ ID NO: 2232 - protein, 7 aa, Human severe acute respiratory syndrome virus
YTVRCCQ

SEQ ID NO: 2233 - protein, 12 aa, Human severe acute respiratory syndrome virus
ITMGNTQHTQTL

SEQ ID NO: 2234 - protein, 5 aa, Human severe acute respiratory syndrome virus
RHQNS

SEQ ID NO: 2235 - protein, 4 aa, Human severe acute respiratory syndrome virus
RLQK

SEQ ID NO: 2236 - protein, 6 aa, Human severe acute respiratory syndrome virus
LRPTWK

SEQ ID NO: 2237 - protein, 14 aa, Human severe acute respiratory syndrome virus
LDLKHYHSRLCKQV

SEQ ID NO: 2238 - protein, 8 aa, Human severe acute respiratory syndrome virus
HSSVSKHV

SEQ ID NO: 2239 - protein, 10 aa, Human severe acute respiratory syndrome virus
QHHHKQCELS

SEQ ID NO: 2240 - protein, 8 aa, Human severe acute respiratory syndrome virus
AKLKLKHT

SEQ ID NO: 2241 - protein, 6 aa, Human severe acute respiratory syndrome virus
AYNQTS

SEQ ID NO: 2242 - protein, 8 aa, Human severe acute respiratory syndrome virus
CQPIQAMS

SEQ ID NO: 2243 - protein, 5 aa, Human severe acute respiratory syndrome virus
YASPS

SEQ ID NO: 2244 - protein, 6 aa, Human severe acute respiratory syndrome virus
QACRPY

SEQ ID NO: 2245 - protein, 20 aa, Human severe acute respiratory syndrome virus
SKQLLQEKVTETSTRMRAYA

SEQ ID NO: 2246 - protein, 6 aa, Human severe acute respiratory syndrome virus
HMQQLP

SEQ ID NO: 2247 - protein, 37 aa, Human severe acute respiratory syndrome virus
MARKHSRKQRKTVTTVYFEQESIVMSRKLKASNDECP

SEQ ID NO: 2248 - protein, 5 aa, Human severe acute respiratory syndrome virus
TYLGR

SEQ ID NO: 2249 - protein, 5 aa, Human severe acute respiratory syndrome virus
HQSIV

SEQ ID NO: 2250 - protein, 5 aa, Human severe acute respiratory syndrome virus
QHQMV

SEQ ID NO: 2251 - protein, 5 aa, Human severe acute respiratory syndrome virus
THLLK

SEQ ID NO: 2252 - protein, 4 aa, Human severe acute respiratory syndrome virus
CYQG

SEQ ID NO: 2253 - protein, 49 aa, Human severe acute respiratory syndrome virus
YDHSYHSAAALSKQHTYLRRQFLFEQKEVPICQHDLVSKVHSCTSLPQG

SEQ ID NO: 2254 - protein, 4 aa, Human severe acute respiratory syndrome virus
SHSK

SEQ ID NO: 2255 - protein, 6 aa, Human severe acute respiratory syndrome virus
ETTYHH

SEQ ID NO: 2256 - protein, 61 aa, Human severe acute respiratory syndrome virus
QQHTAMPKHLMLWLCLYLQPVQFVCQQMDHRIYLLSQYQRVLLLEAPYDAYSRKTRNHNQC

SEQ ID NO: 2257 - protein, 8 aa, Human severe acute respiratory syndrome virus
NQHYHMIH

SEQ ID NO: 2258 - protein, 4 aa, Human severe acute respiratory syndrome virus
GKNL

SEQ ID NO: 2259 - protein, 35 aa, Human severe acute respiratory syndrome virus
VSWHTDKHQMVNHCSMLELKMFDQVGYGQIYTWVS

SEQ ID NO: 2260 - protein, 4 aa, Human severe acute respiratory syndrome virus
KYQL

SEQ ID NO: 2261 - protein, 5 aa, Human severe acute respiratory syndrome virus
ADNFA

SEQ ID NO: 2262 - protein, 18 aa, Human severe acute respiratory syndrome virus
HEVEHCQPEQESYGWICE

SEQ ID NO: 2263 - protein, 5 aa, Human severe acute respiratory syndrome virus
ADLHS

SEQ ID NO: 2264 - protein, 7 aa, Human severe acute respiratory syndrome virus
ACLLLCK

SEQ ID NO: 2265 - protein, 14 aa, Human severe acute respiratory syndrome virus
HVLDSILCHPTTIH

SEQ ID NO: 2266 - protein, 20 aa, Human severe acute respiratory syndrome virus
FHRLLVPCTLQLCLTGMPFS

SEQ ID NO: 2267 - protein, 8 aa, Human severe acute respiratory syndrome virus
NHSAEQQK

SEQ ID NO: 2268 - protein, 15 aa, Human severe acute respiratory syndrome virus
LMSVVVGREHQHLSC

SEQ ID NO: 2269 - protein, 17 aa, Human severe acute respiratory syndrome virus
SHLEPLLSGSKLLHDSW

SEQ ID NO: 2270 - protein, 5 aa, Human severe acute respiratory syndrome virus
YLRLH

SEQ ID NO: 2271 - protein, 15 aa, Human severe acute respiratory syndrome virus
NTCTCYIEQDTCYTV

SEQ ID NO: 2272 - protein, 15 aa, Human severe acute respiratory syndrome virus
VATVSRYAILGTFPC

SEQ ID NO: 2273 - protein, 12 aa, Human severe acute respiratory syndrome virus
AKRYTKQPPRRY

SEQ ID NO: 2274 - protein, 22 aa, Human severe acute respiratory syndrome virus
RTNGSASEKYRIHRLLLSKKAQ

SEQ ID NO: 2275 - protein, 17 aa, Human severe acute respiratory syndrome virus
EKTWQTIEGEPRMKHHW

SEQ ID NO: 2276 - protein, 25 aa, Human severe acute respiratory syndrome virus
NRMSSTSKRLSRLPAESCKLVPDRV

SEQ ID NO: 2277 - protein, 8 aa, Human severe acute respiratory syndrome virus
KTSKTKVH

SEQ ID NO: 2278 - protein, 12 aa, Human severe acute respiratory syndrome virus
QQQHGCTHQKHV

SEQ ID NO: 2279 - protein, 11 aa, Human severe acute respiratory syndrome virus
SSRQHKSPIWQ

SEQ ID NO: 2280 - protein, 20 aa, Human severe acute respiratory syndrome virus
YHQPLLKQTHLKHPQVAQEE

SEQ ID NO: 2281 - protein, 19 aa, Human severe acute respiratory syndrome virus
DSSHQHHRKLLIELCNAHY

SEQ ID NO: 2282 - protein, 6 aa, Human severe acute respiratory syndrome virus
EPIYHW

SEQ ID NO: 2283 - protein, 25 aa, Human severe acute respiratory syndrome virus
IGKYLLLTFRMYHVYSTQHQKLLLL

SEQ ID NO: 2284 - protein, 7 aa, Human severe acute respiratory syndrome virus
QNPPGKC

SEQ ID NO: 2285 - protein, 4 aa, Human severe acute respiratory syndrome virus
WNHP

SEQ ID NO: 2286 - protein, 13 aa, Human severe acute respiratory syndrome virus
AHNECLDEAHYKK

SEQ ID NO: 2287 - protein, 5 aa, Human severe acute respiratory syndrome virus
NPLAN

SEQ ID NO: 2288 - protein, 10 aa, Human severe acute respiratory syndrome virus
CHNNMAQVCP

SEQ ID NO: 2289 - protein, 12 aa, Human severe acute respiratory syndrome virus
KLYTQQQERKQR

SEQ ID NO: 2290 - protein, 6 aa, Human severe acute respiratory syndrome virus
QNHYTQ

SEQ ID NO: 2291 - protein, 12 aa, Human severe acute respiratory syndrome virus
VWKVCSKCCQQH

SEQ ID NO: 2292 - protein, 11 aa, Human severe acute respiratory syndrome virus
KHEVENARSHH

SEQ ID NO: 2293 - protein, 12 aa, Human severe acute respiratory syndrome virus
LLSAQYPVSQAL

SEQ ID NO: 2294 - protein, 5 aa, Human severe acute respiratory syndrome virus
NQSLL

SEQ ID NO: 2295 - protein, 17 aa, Human severe acute respiratory syndrome virus
QLLQGSFCHFCMNHHAG

SEQ ID NO: 2296 - protein, 15 aa, Human severe acute respiratory syndrome virus
TMRQNQHVYLQNNHQ

SEQ ID NO: 2297 - protein, 9 aa, Human severe acute respiratory syndrome virus
HHPEWLCNQ

SEQ ID NO: 2298 - protein, 15 aa, Human severe acute respiratory syndrome virus
FHLCNHHGLTMYVLA

SEQ ID NO: 2299 - protein, 15 aa, Human severe acute respiratory syndrome virus
RYNKPMQQERTIMWP

SEQ ID NO: 2300 - protein, 5 aa, Human severe acute respiratory syndrome virus
QSYHP

SEQ ID NO: 2301 - protein, 4 aa, Human severe acute respiratory syndrome virus
HKLV

SEQ ID NO: 2302 - protein, 28 aa, Human severe acute respiratory syndrome virus
KVCCSSWQQYEFVYAAVQIKTCSLLHSR

SEQ ID NO: 2303 - protein, 11 aa, Human severe acute respiratory syndrome virus
VKHCDFLLLGH

SEQ ID NO: 2304 - protein, 23 aa, Human severe acute respiratory syndrome virus
YALHYSQYMRQDLWASCFQPYYR

SEQ ID NO: 2305 - protein, 17 aa, Human severe acute respiratory syndrome virus
NCYNCHLSLLSQSDVKV

SEQ ID NO: 2306 - protein, 19 aa, Human severe acute respiratory syndrome virus
HPLCQHRYQQHLVGQLTRM

SEQ ID NO: 2307 - protein, 16 aa, Human severe acute respiratory syndrome virus
KGHHLKLHPLLTRCEL

SEQ ID NO: 2308 - protein, 4 aa, Human severe acute respiratory syndrome virus
QQVP

SEQ ID NO: 2309 - protein, 13 aa, Human severe acute respiratory syndrome virus
KLLKRCRHKHQTS

SEQ ID NO: 2310 - protein, 19 aa, Human severe acute respiratory syndrome virus
RKLQYYLQRLIQELGQATE

SEQ ID NO: 2311 - protein, 13 aa, Human severe acute respiratory syndrome virus
VGTSADCSTQKQT

SEQ ID NO: 2312 - protein, 13 aa, Human severe acute respiratory syndrome virus
KQTRRIWTCHQKL

SEQ ID NO: 2313 - protein, 4 aa, Human severe acute respiratory syndrome virus
AVNL

SEQ ID NO: 2314 - protein, 6 aa, Human severe acute respiratory syndrome virus
LSNCLN

SEQ ID NO: 2315 - protein, 38 aa, Human severe acute respiratory syndrome virus
QNGRADVSHRSFDQPCQSRGEARHFSQQHYQQYTMTGQ

SEQ ID NO: 2316 - protein, 11 aa, Human severe acute respiratory syndrome virus
TGVTNHEQLHH

SEQ ID NO: 2317 - protein, 10 aa, Human severe acute respiratory syndrome virus
MYYQCKMCHN

SEQ ID NO: 2318 - protein, 25 aa, Human severe acute respiratory syndrome virus
DNSNCESCRSHGLHLHRHRKISSCH

SEQ ID NO: 2319 - protein, 24 aa, Human severe acute respiratory syndrome virus
LYTQRVWHDCAYSTSCKSKRCNHP

SEQ ID NO: 2320 - protein, 18 aa, Human severe acute respiratory syndrome virus
YEHSSSICSRKKQRRCTS

SEQ ID NO: 2321 - protein, 11 aa, Human severe acute respiratory syndrome virus
PLQKRVPFVQY

SEQ ID NO: 2322 - protein, 4 aa, Human severe acute respiratory syndrome virus
AKNC

SEQ ID NO: 2323 - protein, 9 aa, Human severe acute respiratory syndrome virus
QNSQRTPAL

SEQ ID NO: 2324 - protein, 10 aa, Human severe acute respiratory syndrome virus
LKDLINKRIL

SEQ ID NO: 2325 - protein, 55 aa, Human severe acute respiratory syndrome virus
TTYMPKPTQRPDLKLSSLACTMKSSPEWFQELDKNQGSLIHLNKCCKEKNLHRNP

SEQ ID NO: 2326 - protein, 4 aa, Human severe acute respiratory syndrome virus
DTIL

SEQ ID NO: 2327 - protein, 10 aa, Human severe acute respiratory syndrome virus
RHYNKKEHQN

SEQ ID NO: 2328 - protein, 24 aa, Human severe acute respiratory syndrome virus
IRVHQKQQLHRLENLSKYLTTIAT

SEQ ID NO: 2329 - protein, 8 aa, Human severe acute respiratory syndrome virus
KIWVTSHN

SEQ ID NO: 2330 - protein, 7 aa, Human severe acute respiratory syndrome virus
CRHPNII

SEQ ID NO: 2331 - protein, 4 aa, Human severe acute respiratory syndrome virus
VVKL

SEQ ID NO: 2332 - protein, 4 aa, Human severe acute respiratory syndrome virus
NWYF

SEQ ID NO: 2333 - protein, 8 aa, Human severe acute respiratory syndrome virus
KYTIGTIM

SEQ ID NO: 2334 - protein, 7 aa, Human severe acute respiratory syndrome virus
THKAYNC

SEQ ID NO: 2335 - protein, 7 aa, Human severe acute respiratory syndrome virus
THVVLIS

SEQ ID NO: 2336 - protein, 5 aa, Human severe acute respiratory syndrome virus
RNLML

SEQ ID NO: 2337 - protein, 8 aa, Human severe acute respiratory syndrome virus
LLLVLRMV

SEQ ID NO: 2338 - protein, 11 aa, Human severe acute respiratory syndrome virus
HKPKFYSKEHY

SEQ ID NO: 2339 - protein, 19 aa, Human severe acute respiratory syndrome virus
LQQYHEWQLFLNLRLVKAH

SEQ ID NO: 2340 - protein, 9 aa, Human severe acute respiratory syndrome virus
CLCFPHKQP

SEQ ID NO: 2341 - protein, 10 aa, Human severe acute respiratory syndrome virus
DPHDLTLVLL

SEQ ID NO: 2342 - protein, 6 aa, Human severe acute respiratory syndrome virus
HLHLMV

SEQ ID NO: 2343 - protein, 6 aa, Human severe acute respiratory syndrome virus
HCLQLR

SEQ ID NO: 2344 - protein, 6 aa, Human severe acute respiratory syndrome virus
FSRHTL

SEQ ID NO: 2345 - protein, 5 aa, Human severe acute respiratory syndrome virus
LPSVW

SEQ ID NO: 2346 - protein, 51 aa, Human severe acute respiratory syndrome virus
DFPLLLQRWVVDFHKQDCPFLVCLLLPELQMNLKYLLALYSKDNVNTKCLV

SEQ ID NO: 2347 - protein, 5 aa, Human severe acute respiratory syndrome virus
TLSWL

SEQ ID NO: 2348 - protein, 10 aa, Human severe acute respiratory syndrome virus
CAKQLAYAVI

SEQ ID NO: 2349 - protein, 9 aa, Human severe acute respiratory syndrome virus
NSLNSVYSQ

SEQ ID NO: 2350 - protein, 11 aa, Human severe acute respiratory syndrome virus
PLHRHSSLGRM

SEQ ID NO: 2351 - protein, 9 aa, Human severe acute respiratory syndrome virus
QIALVKLAL

SEQ ID NO: 2352 - protein, 13 aa, Human severe acute respiratory syndrome virus
SLSFDLNHQQILC

SEQ ID NO: 2353 - protein, 16 aa, Human severe acute respiratory syndrome virus
NYQNSHLVMVELVQGL

SEQ ID NO: 2354 - protein, 23 aa, Human severe acute respiratory syndrome virus
AALYSKHYPFYNTHPILVQSLCK

SEQ ID NO: 2355 - protein, 9 aa, Human severe acute respiratory syndrome virus
LHRVYTTQA

SEQ ID NO: 2356 - protein, 20 aa, Human severe acute respiratory syndrome virus
CKMFPCRKHQSLVLCTLTSL

SEQ ID NO: 2357 - protein, 11 aa, Human severe acute respiratory syndrome virus
GELRQYDRGSP

SEQ ID NO: 2358 - protein, 35 aa, Human severe acute respiratory syndrome virus
QLYECNDHTDSYQCTHSHIRMYLAVIYTQQVVQTS

SEQ ID NO: 2359 - protein, 11 aa, Human severe acute respiratory syndrome virus
QKKTLVVLDIV

SEQ ID NO: 2360 - protein, 13 aa, Human severe acute respiratory syndrome virus
HHDHTHMEWKHLS

SEQ ID NO: 2361 - protein, 18 aa, Human severe acute respiratory syndrome virus
DYHKIEYPYTSQLLHPLR

SEQ ID NO: 2362 - protein, 10 aa, Human severe acute respiratory syndrome virus
FSDHNVYTPH

SEQ ID NO: 2363 - protein, 8 aa, Human severe acute respiratory syndrome virus
ELALQIPN

SEQ ID NO: 2364 - protein, 7 aa, Human severe acute respiratory syndrome virus
HAVEDGS

SEQ ID NO: 2365 - protein, 14 aa, Human severe acute respiratory syndrome virus
HHQARQQFYYCKRV

SEQ ID NO: 2366 - protein, 4 aa, Human severe acute respiratory syndrome virus
VHKS

SEQ ID NO: 2367 - protein, 17 aa, Human severe acute respiratory syndrome virus
QHHQHGLYNKPLEVLVH

SEQ ID NO: 2368 - protein, 10 aa, Human severe acute respiratory syndrome virus
LQAVEVLIKH

SEQ ID NO: 2369 - protein, 9 aa, Human severe acute respiratory syndrome virus
TNNNCYQPI

SEQ ID NO: 2370 - protein, 44 aa, Human severe acute respiratory syndrome virus
LKLNHQLEEISISLCGLKQTCTYQENSHQEYGSTRKLHYVVCHH

SEQ ID NO: 2371 - protein, 14 aa, Human severe acute respiratory syndrome virus
VVQRKSYPHDLHEV

SEQ ID NO: 2372 - protein, 16 aa, Human severe acute respiratory syndrome virus
HQHHPSMLDQTAVHMS

SEQ ID NO: 2373 - protein, 9 aa, Human severe acute respiratory syndrome virus
TYPQAVCGD

SEQ ID NO: 2374 - protein, 5 aa, Human severe acute respiratory syndrome virus
CCPQL

SEQ ID NO: 2375 - protein, 37 aa, Human severe acute respiratory syndrome virus
PPAGIRDSLVCQVKEPHRQDETRRGSPECGTQFCHHA

SEQ ID NO: 2376 - protein, 37 aa, Human severe acute respiratory syndrome virus
EIQHLTLYAVLNRTNLCKSQPKKLFLQSAPQMSLMTK

SEQ ID NO: 2377 - protein, 5 aa, Human severe acute respiratory syndrome virus
GIHYM

SEQ ID NO: 2378 - protein, 13 aa, Human severe acute respiratory syndrome virus
QHLVMILTLRQEL

SEQ ID NO: 2379 - protein, 11 aa, Human severe acute respiratory syndrome virus
ENAYSAQPLQD

SEQ ID NO: 2380 - protein, 10 aa, Human severe acute respiratory syndrome virus
NHVSHNQLAL

SEQ ID NO: 2381 - protein, 10 aa, Human severe acute respiratory syndrome virus
QAAHLESSAS

SEQ ID NO: 2382 - protein, 6 aa, Human severe acute respiratory syndrome virus
KLQALY

SEQ ID NO: 2383 - protein, 16 aa, Human severe acute respiratory syndrome virus
YKRRIGHHSQRCPLEF

SEQ ID NO: 2384 - protein, 13 aa, Human severe acute respiratory syndrome virus
FLYTYVGWLPLWL

SEQ ID NO: 2385 - protein, 4 aa, Human severe acute respiratory syndrome virus
HPCI

SEQ ID NO: 2386 - protein, 26 aa, Human severe acute respiratory syndrome virus
ALIFLSLQHEQAFLSNSRIQFLESLP

SEQ ID NO: 2387 - protein, 14 aa, Human severe acute respiratory syndrome virus
VLLKVVHKMQICIS

SEQ ID NO: 2388 - protein, 32 aa, Human severe acute respiratory syndrome virus
LPQVYNQHILVQGTWLYTHQLALSSKLLRASQ

SEQ ID NO: 2389 - protein, 12 aa, Human severe acute respiratory syndrome virus
CHQPFWRVLQHK

SEQ ID NO: 2390 - protein, 18 aa, Human severe acute respiratory syndrome virus
HHLPCKVHPSQGKTYLHL

SEQ ID NO: 2391 - protein, 11 aa, Human severe acute respiratory syndrome virus
ACSENHGKAYH

SEQ ID NO: 2392 - protein, 9 aa, Human severe acute respiratory syndrome virus
YQQTRVTYW

SEQ ID NO: 2393 - protein, 6 aa, Human severe acute respiratory syndrome virus
FLPVLW

SEQ ID NO: 2394 - protein, 6 aa, Human severe acute respiratory syndrome virus
PHQCRP

SEQ ID NO: 2395 - protein, 28 aa, Human severe acute respiratory syndrome virus
FLASHRQASVRQISPQFWNLLCLVAPLV

SEQ ID NO: 2396 - protein, 4 aa, Human severe acute respiratory syndrome virus
VLPL

SEQ ID NO: 2397 - protein, 8 aa, Human severe acute respiratory syndrome virus
ASGYQDNP

SEQ ID NO: 2398 - protein, 9 aa, Human severe acute respiratory syndrome virus
QPAHKELCH

SEQ ID NO: 2399 - protein, 20 aa, Human severe acute respiratory syndrome virus
LQYKPVYEPSARTLVKTEVV

SEQ ID NO: 2400 - protein, 17 aa, Human severe acute respiratory syndrome virus
HQICLLTTMVQVRCPVN

SEQ ID NO: 2401 - protein, 6 aa, Human severe acute respiratory syndrome virus
NFHMLP

SEQ ID NO: 2402 - protein, 10 aa, Human severe acute respiratory syndrome virus
EAGCPHLHLG

SEQ ID NO: 2403 - protein, 8 aa, Human severe acute respiratory syndrome virus
VQQHADTS

SEQ ID NO: 2404 - protein, 13 aa, Human severe acute respiratory syndrome virus
QDYVQKANKTLLL

SEQ ID NO: 2405 - protein, 5 aa, Human severe acute respiratory syndrome virus
EGHLA

SEQ ID NO: 2406 - protein, 15 aa, Human severe acute respiratory syndrome virus
CNHHSPFAWHHWLPC

SEQ ID NO: 2407 - protein, 13 aa, Human severe acute respiratory syndrome virus
VHLLHHHHVSGVC

SEQ ID NO: 2408 - protein, 6 aa, Human severe acute respiratory syndrome virus
QHLQSP

SEQ ID NO: 2409 - protein, 5 aa, Human severe acute respiratory syndrome virus
HFVPP

SEQ ID NO: 2410 - protein, 5 aa, Human severe acute respiratory syndrome virus
RCQHI

SEQ ID NO: 2411 - protein, 5 aa, Human severe acute respiratory syndrome virus
WQHCQ

SEQ ID NO: 2412 - protein, 5 aa, Human severe acute respiratory syndrome virus
VLNNQ

SEQ ID NO: 2413 - protein, 5 aa, Human severe acute respiratory syndrome virus
LVLQV

SEQ ID NO: 2414 - protein, 11 aa, Human severe acute respiratory syndrome virus
VLVLAQSLIAQ

SEQ ID NO: 2415 - protein, 80 aa, Human severe acute respiratory syndrome virus
YHPASLPLLLPQLELFQLRHQIPEGDLDNHPLYRTHVHRFHQFLLPHTLHRPLLPHLEGKRNNTYVMKSFLHQHHQISRM

SEQ ID NO: 2416 - protein, 12 aa, Human severe acute respiratory syndrome virus
LHSTHQDQYPCW

SEQ ID NO: 2417 - protein, 21 aa, Human severe acute respiratory syndrome virus
GDQKLVVKSSQQPLLQHMQTQ

SEQ ID NO: 2418 - protein, 14 aa, Human severe acute respiratory syndrome virus
LRYRIQQCRQSTFH

SEQ ID NO: 2419 - protein, 11 aa, Human severe acute respiratory syndrome virus
ALCQHVHQAQM

SEQ ID NO: 2420 - protein, 20 aa, Human severe acute respiratory syndrome virus
FSHSCNLELPKQYLLQRLHL

SEQ ID NO: 2421 - protein, 12 aa, Human severe acute respiratory syndrome virus
LVHPLLSERHCL

SEQ ID NO: 2422 - protein, 14 aa, Human severe acute respiratory syndrome virus
PVNQETMRSIVLCP

SEQ ID NO: 2423 - protein, 4 aa, Human severe acute respiratory syndrome virus
SLRA

SEQ ID NO: 2424 - protein, 10 aa, Human severe acute respiratory syndrome virus
GHLHRLVCRR

SEQ ID NO: 2425 - protein, 14 aa, Human severe acute respiratory syndrome virus
SYQRASRVLRVHRS

SEQ ID NO: 2426 - protein, 6 aa, Human severe acute respiratory syndrome virus
EQPPQR

SEQ ID NO: 2427 - protein, 17 aa, Human severe acute respiratory syndrome virus
VLCHVNHLQERLLLLVP

SEQ ID NO: 2428 - protein, 20 aa, Human severe acute respiratory syndrome virus
VVAAAPCHVYTDGKVPCFER

SEQ ID NO: 2429 - protein, 5 aa, Human severe acute respiratory syndrome virus
RLHLS

SEQ ID NO: 2430 - protein, 8 aa, Human severe acute respiratory syndrome virus
VIATLRQR

SEQ ID NO: 2431 - protein, 10 aa, Human severe acute respiratory syndrome virus
LDQCTFRVPC

SEQ ID NO: 2432 - protein, 6 aa, Human severe acute respiratory syndrome virus
SILHNP

SEQ ID NO: 2433 - protein, 10 aa, Human severe acute respiratory syndrome virus
CYLKQPVFDP

SEQ ID NO: 2434 - protein, 6 aa, Human severe acute respiratory syndrome virus
RCQKHL

SEQ ID NO: 2435 - protein, 6 aa, Human severe acute respiratory syndrome virus
ESPKHP

SEQ ID NO: 2436 - protein, 6 aa, Human severe acute respiratory syndrome virus
EIQLLH

SEQ ID NO: 2437 - protein, 8 aa, Human severe acute respiratory syndrome virus
VSPQSIQR

SEQ ID NO: 2438 - protein, 4 aa, Human severe acute respiratory syndrome virus
VFQQ

SEQ ID NO: 2439 - protein, 4 aa, Human severe acute respiratory syndrome virus
CPKD

SEQ ID NO: 2440 - protein, 16 aa, Human severe acute respiratory syndrome virus
TTTEKSVVQDHQLHMP

SEQ ID NO: 2441 - protein, 23 aa, Human severe acute respiratory syndrome virus
AGLKYKPWRRQDVMTVQKYHQVW

SEQ ID NO: 2442 - protein, 22 aa, Human severe acute respiratory syndrome virus
QLLFANQELSGLLHQVCAQKLI

SEQ ID NO: 2443 - protein, 31 aa, Human severe acute respiratory syndrome virus
HQQPVRENHTVVLKLISVVQCSKHLLRAFPW

SEQ ID NO: 2444 - protein, 11 aa, Human severe acute respiratory syndrome virus
LYSYRRTQQWF

SEQ ID NO: 2445 - protein, 8 aa, Human severe acute respiratory syndrome virus
KTCNQDSL

SEQ ID NO: 2446 - protein, 7 aa, Human severe acute respiratory syndrome virus
KQRKMPK

SEQ ID NO: 2447 - protein, 13 aa, Human severe acute respiratory syndrome virus
WQPLHSNENRQQC

SEQ ID NO: 2448 - protein, 20 aa, Human severe acute respiratory syndrome virus
HVHDSVSQGDPHSRSPHCHQ

SEQ ID NO: 2449 - protein, 10 aa, Human severe acute respiratory syndrome virus
CQYGLSQYQH

SEQ ID NO: 2450 - protein, 23 aa, Human severe acute respiratory syndrome virus
HEEPSRHAYYSSQHRQTHSLQNI

SEQ ID NO: 2451 - protein, 40 aa, Human severe acute respiratory syndrome virus
SYLPCGVEFQCLSGCDNLQHYAQVQSLGLDRQDMAFSLQH

SEQ ID NO: 2452 - protein, 5 aa, Human severe acute respiratory syndrome virus
VGTHM

SEQ ID NO: 2453 - protein, 31 aa, Human severe acute respiratory syndrome virus
LNFQCHNVHKWLSESRTSAMKLHRNDYISSR

SEQ ID NO: 2454 - protein, 21 aa, Human severe acute respiratory syndrome virus
TSAYCYTPVEMQQGTQSVYAP

SEQ ID NO: 2455 - protein, 12 aa, Human severe acute respiratory syndrome virus
NPQSFSFQHVVE

SEQ ID NO: 2456 - protein, 10 aa, Human severe acute respiratory syndrome virus
EETQTLGIPL

SEQ ID NO: 2457 - protein, 8 aa, Human severe acute respiratory syndrome virus
KCQISWHS

SEQ ID NO: 2458 - protein, 15 aa, Human severe acute respiratory syndrome virus
FRRVSGARSSYQSAQ

SEQ ID NO: 2459 - protein, 39 aa, Human severe acute respiratory syndrome virus
TRQFHAHGHGSSRHLSSTRCNQVVRKECTLTCPRVRENL

SEQ ID NO: 2460 - protein, 18 aa, Human severe acute respiratory syndrome virus
CNQEGTHLGHRNCCRHSE

SEQ ID NO: 2461 - protein, 4 aa, Human severe acute respiratory syndrome virus
LHLH

SEQ ID NO: 2462 - protein, 9 aa, Human severe acute respiratory syndrome virus
VHGVHHCHA

SEQ ID NO: 2463 - protein, 91 aa, Human severe acute respiratory syndrome virus
CSSFVHNLQWDQCQARHLSHKTLDRCHSYDHRLPYYRSYEEEHCGMQLGFRPHVARVLPVLYRYDRTECRPFLQPAQRPCGRDWCLRHQNV

SEQ ID NO: 2464 - protein, 23 aa, Human severe acute respiratory syndrome virus
THRAVQAGAVRLFPALLDHKCHF

SEQ ID NO: 2465 - protein, 22 aa, Human severe acute respiratory syndrome virus
GVHVPPIGPLPQSPRSHALARL

SEQ ID NO: 2466 - protein, 6 aa, Human severe acute respiratory syndrome virus
PEGQAN

SEQ ID NO: 2467 - protein, 7 aa, Human severe acute respiratory syndrome virus
VGRVFSR

SEQ ID NO: 2468 - protein, 47 aa, Human severe acute respiratory syndrome virus
HQEQGSPSYLSVTPGRNLGMLMIDCNTDETVSSLQKRDELLVSCQRQ

SEQ ID NO: 2469 - protein, 22 aa, Human severe acute respiratory syndrome virus
NLLLFILRRCTRHAAERQLHRF

SEQ ID NO: 2470 - protein, 24 aa, Human severe acute respiratory syndrome virus
SSFREQIYKRSRLVGFSWVGKNLI

SEQ ID NO: 2471 - DNA, 1269 bp, Human severe acute respiratory syndrome virus
atgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataa

SEQ ID NO: 2472 - protein, 422 aa, Human severe acute respiratory syndrome virus
MSDNGPQSNQRSAPRITFGGPTDSTDNNQNGGRNGARPKQRRPQGLPNNTASWFTALTQHGKEELRFPRGQGVPINTNSGPDDQIGYYRRATRRVRGGDGKMKELSPRWYFYYLGTGPEASLPYGANKEGIVWVATEGALNTPKDHIGTRNPNNNAATVLQLPQGTTLPKGFYAEGSRGGSQASSRSSSRSRGNSRNSTPGSSRGNSPARMASGGGETALALLLLDRLNQLESKVSGKGQQQQGQTVTKKSAAEASKKPRQKRTATKQYNVTQAFGRRGPEQTQGNFGDQDLIRQGTDYKHWPQIAQFAPSASAFFGMSRIGMEVTPSGTWLTYHGAIKLDDKDPQFKDNVILLNKHIDAYKTFPPTEPKKDKKKKTDEAQPLPQRQKKQPTVTLLPAADMDDFSRQLQNSMSGASADSTQA

SEQ ID NO: 2473 - DNA, 3768 bp, Human severe acute respiratory syndrome virus
atgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataa

SEQ ID NO: 2474 - protein, 1255 aa, Human severe acute respiratory syndrome virus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 2475 - DNA, 21 bp, Artificial Sequence
  Description of Artificial Sequence: Primer
gactgatgaagctcaggcctt

SEQ ID NO: 2476 - DNA, 21 bp, Artificial Sequence
  Description of Artificial Sequence: Primer
cttgtgtggtcatcatgagtg

SEQ ID NO: 2477 - DNA, 18 bp, Artificial Sequence
  Description of Artificial Sequence: Primer
cacagaggaacttctttt

SEQ ID NO: 2478 - DNA, 24 bp, Artificial Sequence
  Description of Artificial Sequence: Primer
tcccaattcttgaaggtcaatgag

SEQ ID NO: 2479 - DNA, 10 bp, Human severe acute respiratory syndrome virus
ctaaacgaac

SEQ ID NO: 2480 - DNA, 19 bp, Artificial Sequence
  Description of Artificial Sequence: Primer
gcagtcaagcctcttctcg

SEQ ID NO: 2481 - DNA, 18 bp, Artificial Sequence
  Description of Artificial Sequence: Primer
gcctcagcagcagatttc

SEQ ID NO: 2482 - DNA, 18 bp, Artificial Sequence
  Description of Artificial Sequence: Primer
tgagaccttcaacacgcc

SEQ ID NO: 2483 - DNA, 18 bp, Artificial Sequence
  Description of Artificial Sequence: Primer
atctgctggaaggtggac

SEQ ID NO: 2484 - DNA, 166 bp, Artificial Sequence
  Description of Artificial Sequence: Probe
gatataaaattcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtg

SEQ ID NO: 2485 - DNA, 188 bp, Artificial Sequence
  Description of Artificial Sequence: Probe
catgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtag

SEQ ID NO: 2486 - DNA, 130 bp, Artificial Sequence
  Description of Artificial Sequence: Probe
gctgtgacattaaggacctgccaaaagagatcactgtggctacatcacgaacgctttcttattacaaattaggagcgtcgcagcgtgtaggcactgattcaggttttgctgcatacaaccgctaccgtat

SEQ ID NO: 2487 - DNA, 146 bp, Artificial Sequence
  Description of Artificial Sequence: Probe
gcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattg

What is claimed:

1. A method for detecting the presence of a N-gene of the hSARS virus in a biological sample, said method comprising:

(a) contacting the sample with a nucleic acid molecule consisting essentially of the nucleotide sequence of SEQ ID NO:2475, 2476, 2480 and/or 2481; and (b) detecting whether the nucleic acid molecule binds to said N-gene in the sample.

2. A method for identifying a subject infected with the hSARS virus, said method comprising:

(a) obtaining total RNA from a biological sample obtained from the subject (b) reverse transcribing the total RNA to obtain cDNA; and (c) subjecting the cDNA to real-time PCR assay using a set of primers consisting essentially of the nucleotide sequences of SEQ ID NOS:2475 and 2476, respectively.

3. A method for identifying a subject infected with the hSARS virus, said method comprising:

(a) obtaining total RNA from a biological sample obtained from the subject (b) reverse transcribing the total RNA to obtain cDNA; and (c) subjecting the cDNA to real-time PCR assay using a set of primers, consisting essentially of the nucleotide sequences of SEQ ID NOS:2480 and 2481, respectively.

4. A kit comprising in one or more containers one or more isolated nucleic acid molecules consisting essentially of the nucleotide sequence of SEQ ID NO:2475 and/or SEQ ID NO:2476.

5. A kit comprising in one or more containers one or more isolated nucleic acid molecules consisting essentially of the nucleotide sequence of SEQ ID NO:2480 and/or SEQ ID NO:2481.

* * * * *

UNITED STATES PATENT AND TRADEMARK OFFICE
CERTIFICATE OF CORRECTION

PATENT NO. : 7,547,512 B2
APPLICATION NO. : 10/807807
DATED : June 16, 2009
INVENTOR(S) : Joseph S. M. Peiris et al.

It is certified that error appears in the above-identified patent and that said Letters Patent is hereby corrected as shown below:

Column 11, Line 43:
"P-actin" should read --β-actin--

Column 18, Line 65:
"portion thereof The" should read --portion thereof. The--

Column 27, Line 16:
"D-isoglutamnine" should read --D-isoglutamine--

Column 29, Line 22:
"myelorna" should read --myeloma--

Column 31, Line 17:
"F(ab)$_2$" should read --F(ab')$_2$--

Column 41, Line 67:
"AGC-GTTG-3'" should read --AGCGTTG-3'--

Column 42, Line 50:
"Ouantitative" should read --Quantitative--

Column 47, Line 6:
"TRIzol°" should read --TRIzol®--

UNITED STATES PATENT AND TRADEMARK OFFICE
CERTIFICATE OF CORRECTION

PATENT NO. : 7,547,512 B2
APPLICATION NO. : 10/807807
DATED : June 16, 2009
INVENTOR(S) : Joseph S. M. Peiris et al.

It is certified that error appears in the above-identified patent and that said Letters Patent is hereby corrected as shown below:

Column 54, Line 28:
"(n11)" should read --(n=11)--

Signed and Sealed this

Third Day of November, 2009

David J. Kappos
*Director of the United States Patent and Trademark Office*